United States Patent 12,569,549 (FLAVIVIRUS VACCINE) - sequence listing, part 15

SEQ ID NO: 7688 - RNA, 9873 nt, synthetic construct
  misc_feature 1..9873: note = derived and/or modified CDS sequence (wt) from DENV-3__FJ461329__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaagactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaagaaacacatgattgcaggggttctcttcacgtttgtgctccttctctcagggcaaataacatggagagatatggcacacacactcataatgattggatccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatatcccacttcaatggatcgcgtcggctatagttctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagataaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagctaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattgaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggacttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttatcatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcactaacatggaagcccagttggtcagacagatggaaggagaaggcgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctatgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcaatgaagaatttctggactacatgccttcgatgaagagattcaggaaggaggaggagtcagagggagccatttggtaa

SEQ ID NO: 7689 - RNA, 9873 nt, synthetic construct
  misc_feature 1..9873: note = derived and/or modified CDS sequence (wt) from DENV-3__KF955459__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcgcatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaggaagtctccgaaacgcagcatgggacaatactcattaaggtcgagtacaaaggggaagatgcaccttgcaagattcctttctccacagaggatggacaagggaaagcccacaatggtagattaatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcagcaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagttatcacagaaaactgtgggacaagaggcccatcattgagaacaacaacagtgtcagggaagctgatacacgaatggtgttgccgctcgtgcacacttcctcctttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgtcctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagatttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagacccagccagtatagcggctagagggtacatatcaacacgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatctcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgcgttattgtttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattgaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccaattggtcagacagatggaaggagaaggcgttttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7690 - RNA, 9873 nt, synthetic construct
  misc_feature 1..9873: note = derived and/or modified CDS sequence (wt) from DENV-3__FJ547066__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaaatggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcgcatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaggaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagttatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgtcctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggaggttgagcgcacaatggcaaaagggagaggaggtgcaggttattgccgtagagcctgggaagaacccaaaaaacttccaaaccatgccgggcatttttcagacaacaacgggggaaataggagcaattgcactagatttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaaatgttcaaaaagcgaaatctaaccataatggatctacatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgcgttattgtttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcagctaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgagggattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacaggcaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccaattggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7691 - RNA, 9873 nt, synthetic construct
  misc_feature 1..9873: note = derived and/or modified CDS sequence (wt) from DENV-3__KF955460__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttacactactaatgctggtcactccatccatgacaatgagatgcgtgggagtaggaaatagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctactcagggggaagcgattctacctgaagagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgttatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacttttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggaaacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcctacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcgtgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtctttacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctctttgaagaggtgatgagaggaaaatttgggaaaaaacacatgattgcaggggttctcttcacgtttgtgctccttctctcagggcaaataacatggagagatatggcacatacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggattaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcccgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatttaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaaaggatattccggaacgctcatggaattcaggcaatgaatggattaccgactttgttggaaagacggtgtggtttgtacctagcatcaaagctggaaatgacatagcaaactgcctgcggaaaaatggaaaaaaggtcatccaacttagcagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgtcgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttgggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaatatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcagaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggatgaactgataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatattccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7692 - RNA, 9873 nt, synthetic construct
  misc_feature 1..9873: note = derived and/or modified CDS sequence (wt) from DENV-3__FJ461334__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcgcatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaggaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccctggcacttgggaaaattggagctggactttaactattgtgaaggaacaacagtagttatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatacagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcacacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagacccagccagtatagcggctagaggatacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgcgttattgtttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgctattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatctcggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtattggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggtgatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccaattggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccccacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7693 - RNA, 9873 nt, synthetic construct
  misc_feature 1..9873: note = derived and/or modified CDS sequence (wt) from DENV-3__FJ461337__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtggttgtccttggatcgcaagagggagcaatgcacacagcactgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcaatgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaagactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacagcgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaatatcgtctcttcagtcaacatggtatccagattgctactgaacagatttacgatgacacacaggagacccaccatagagaaagatgtggacttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7694 - RNA, 9873 nt, synthetic construct
  misc_feature 1..9873: note = derived and/or modified CDS sequence (wt) from DENV-3__FJ461338__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttacaaatgccccctcgttgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccaaggggaagcgattctacctgaagagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaagaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaatcaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccttgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactccccgaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaacgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaactgacatctagagaaaatttgttgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcactctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagttatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaattgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtggtgggactgtatggcaatggagtggttacgaaaaatggtggctacgtcagtggaatagcgcaaacaaatgcagaaccagatggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatggaaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaataatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaattgagacctaggtggcttgatgcccgcacttattcagatcccttagcacttaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttgttaacaggtggagcaatgcttttcctgatatcaggtaaagggattggaaagacttcaataggactcatttgtgttattgtttccagtggtatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactagcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttgggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggttgtggaagaggaggctggtcatattattgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaatatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtgccagtccattggatccctacaagcagaacgacatggtctattcacgctcaccatcagtggatgaccacagaagacatgctaactgtctggaacagggtgtggatagaggacaatccatggatggaagacaaaactccagttacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7695 - RNA, 9873 nt, synthetic construct
  misc_feature 1..9873: note = derived and/or modified CDS sequence (wt) from DENV-3__FJ562103__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttatagatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttacactactaatgctggtcactccatccatgacaatgagatgcgtgggagtaggaaatagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctactcagggggaagcgattctacctgaagagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgttatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacttttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggaaacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcctacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcgtgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctccttcataatagatgggccaaacacaccggagtgtccaagtgcctcaagagcatggaatgtgtgggaggtggaagattacgggtttggagtctttacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctctttgaagaggtgatgagaggaaaatttgggaaaaaacacatgattgcaggggttctcttcacgtttgtgctccttctctcagggcaaataacatggagagatatggcacatacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggattaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcccgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatttaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaaaggatattccggaacgctcatggaattcaggcaatgaatggattaccgactttgttggaaagacggtgtggtttgtacctagcatcaaagctggaaatgacatagcaaactgcctgcggaaaaatggaaaaaaggtcatccaacttagcagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgtcgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttgggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaatatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcagaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggatgaactgataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatattccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7696 - RNA, 9873 nt, synthetic construct
  misc_feature 1..9873: note = derived and/or modified CDS sequence (wt) from DENV-3__FJ898456__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggccttcaggcacccagggttcacaatactagccctatttcttgcccattacataggcacttccttgacccagaaagtggttattttcatactactaatgctggtcaccccatccatgacaatgagatgtgtgggagtaggaaacagagactttgtggaaggcctatcaggagctacgtgggttgacgtggtgctcgagcacggtgggtgtgtgactactatggccaagaacaagcccacgttggatatagagctccagaagaccgaggccacccaactggcgaccctaaggaaactatgtattgagggaaaaattaccaacgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacgtgcgcgaaatttcaatgtttggaatcaattgagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaaacaagaagtagtagtccttggatcgcaagagggagcaatgcacacagcactgacaggagccacagagatccaaacctcaggaggcacaagtatttttgcggggcacttaaaatgtagactcaagatggacaaattggaactcaaggggatgagctatgcaatgtgcttgaatgctttcgtgttgaagaaagaagtctctgaaacgcaacatgggacaatactcattaaggttgagtacaaaggggaagatgcaccttgcaagattcctttctccacggaggatggacaagggaaagcccacaatggcagactgatcacagctaacccaatagtgaccaagaaggaggagcctgtcaacattgaggcagaacctccttttggggaaagtaatatagtaattggaattggagacaaagccttgaaaatcaactggtacaagaaaggaagctcgattgggaagatgttcgaggccactgccagaggtgcaaggcgcatggccatcttgggagacacagcctgggactttggatcagtaggtggcgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaattttcgtcaccaatgaggtccacacctggacagagcaatacaagtttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattgggatcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacatgccgacatgggctattggatagaaagccaaaagaatggaagttggaagctagaaaaggcatccctcatagaggtaaagacctgcacatggccaaaatcacacactctttggagcaatggtgtgctagagagtgacatgatcatcccaaagagtctggctggtcccatttcgcaacacaactacaggcccggataccacacccaaaccgcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccttgcgatacatgggagaagacggctgctggtatggcatggaaatcagacccattaatgagaaagaagagaacatggtaaagtctttagtctcagcagggagtggaaaggcggataacttcacaatgggtgtcttgtgtttggcaatcttctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttagccatggcaacaacgttacaactgccagaggacattgaacaaatggcgaatggaatagctttagggctcatggctcttaaattaataacacaatttgaaacataccaactatggacggcactagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccatccctaccactttttattttcagtttaaaagacacgctcaaaaggagaagctggccactgaatgagggggtgatggctgttggacttgtgagcatcctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcataccatgtggcacgtcacaagaggagcagtgttgacacacaatgggaaaagactggaaccaaactgggctaatgtgaaaaaagatctgatttcatacggaggaggatggaaattgagtgcacaatggcaaaaaggagaggaggtgcaagttattgctgtagagcctgggaagaacccaaagagctttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcgatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttaatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgacttcgccgggaagacggtgtggtttgtccctagcattaaagctggaaatgacatagcaaactgcttgcggaaaaatggaaaaaaggtcattcaacttagtaggaagacttttaacacagaatatcaaaagactaaactgaatgattgggactttgtggtgacaacagacatttcagaaatgggagccaatttcaaagcagacagagtgatcgacccaagaagatgcctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcgaaaatgctgttagacaacatcaacacaccagaagggattataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagagcgcaataatcaaattttagaggagaatatggatgtggaaatctggacaaaggaaggagagaagaaaaaattgagacctaggtggcttgatgcccgcacttattcagatccattagcgctcaaggaatttaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattagcactgggttgttattcacaagtgaacccactaactctcacagcggcagtactcctgctagtcacgcattatgctatcataggcccaggattacaggcaaaagccactcgtgaagctcaaaaaaggacagctgctggaataatgaagaatccaacagtggatgggataatgacaatagacctagaccctgtgatatacgattcaaaatttgaaaaacaactaggacaggtcatgcttctagtattgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggaaagaacagaagccaaagaagggttgaaaagaggagaaataacacaccatgccgtgtccagaggcagcgcaaaacttcaatggttcgtggagagaaacatggtcatccccgaaggaagagtcatagatttaggctgtggaagaggaggctggtcatattattgtgcaggactgaaaaaagttacagaagtgcgaggatacacaaaaggcggcccaggacatgaagaaccagtacccatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtattggatatctaatggcacaggcaatatcgtttcttctgtcaacatggtatccagattgctactgaacagattcacaatgacacataggagacccaccatagaaaaagatgtggatttaggagcggggacccgacatgttaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagagtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgctgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagatatctccaagatacccggaggagctatgtatgctgatgacacagctggttgggacacaagaataacagaagatgacctgcacaatgaggaaaaaatcacacagcaaatggaccctgaacacaggcggttagcaaacgctatattcaagctcacataccaaaacaaagtggtcaaagttcaacgaccaactccaaagggcacggtaatggacatcatatctaggaaagaccaaagaggcagtggacaggtggggacttatggtctgaacacattcaccaacatggaagcccagttaatcagacaaatggaaggagaaggtgtgttgtcgaaggcagacctcgagaaccctcacctgctagagaagaaagttacacaatggttggaaacaaaaggagtggagaggttaaaaagaatggccatcagcggggatgattgcgtggtgaaaccaattgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccacaggatgaattaatcgggagagctagaatctctcaaggagcaggatggagcctcagagaaactgcatgcctagggaaagcctacgcccaaatgtgggccctcatgtactttcacagaagagatcttagactagcatccaacgccatatgttcagcagtgccagtccattgggtccctacaagcagaacgacgtggtctattcacgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcgcttccagagcaacctgggcccagaacatacttacggcaattcaacaggtgagaagccttataggcaatgaagagtttctggactacatgccttcaatgaagagattcaggaaggaggaggagtcagagggagccatttggtaa

SEQ ID NO: 7697 - RNA, 9873 nt, synthetic construct
  misc_feature 1..9873: note = derived and/or modified CDS sequence (wt) from DENV-3__JN697379__SS-prME
  source 1..9873: mol_type = other RNA
acatcgctctgtctcatgatgatgttaccagcaacacttgctttccacttaacttcacgagatggagagccgcgcatgattgtggggaagaatgaaagaggaaaatccctactttttaagacagcctctggaatcaacatgtgcacactcatagccatggatttgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgtcggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtgggagtaggaaacagagattttgtggaaggcctatcgggagccacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagttacggctgagataacatcccaggcatcaaccgctgaagtcattttacctgaatatggaaccctcgggctagaatgctcaccacggacaggtttggatttcaatgaaatgattttattgacaatgaagaacaaagcatggatggtacatagacaatggttctttgacttacccctaccatggacatcaggagctacaacagaaacaccaacttggaacaggaaagagcttcttgtgacatttaaaaatgcacatgcaaaaaagcaagaagtagttgtccttggatcacaagagggagcaatgcatacagcactgacaggagctacagagatccaaacctcaggaggcacaagtatttttgcggggcacttaaaatgtagactcaagatggacaaattgaaactcaaggggatgagctatgcaatgtgcttgaatacctttgtgttgaaaaaagaagtctccgaaacgcagcatgggacaatactcattaaggttgagtacaaaggggaagatgcaccctgcaagattcctttctccacggaggatggacaagggaaagctcacaatggcagactgatcacagccaatccagtggtgaccaagaaggaggagcctgtcaacattgaggctgaacctccttttggggaaagtaatatagtaattggaattggagacaaagccctgaaaatcaactggtacaggaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttagtggagtctcctggataatgaaaattggaataggtgtcctcttaacctggatagggttgaattcaaaaaacacttctatgtcattttcatgcattgcgataggaatcattacactctatctgggagtcgtggtgcaagctgacatggggtgtgtcataaactggaaaggcaaagaactcaaatgtggaagtggaattttcgtcactaatgaggtccacacctggacagagcaatacaaatttcaagcagactcccccaaaagactggcaacagccattgcaggcgcttgggagaatggagtgtgcggaattaggtcaacaaccagaatggagaacctcttgtggaagcaaatagccaatgaactgaactacatattatgggaaaacaacattaaattaacggtagttgtaggcgacataactggggtcttagagcaagggaaaagaacactaacaccacaacccatggagctaaaatattcttggaaaacatggggaaaggcaaaaatagtgacagctgaaacacaaaattcctctttcataatagatgggccaagcacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagccgtcaaggatgagagggccgtacacgccgacatgggctattggatagaaagccaaaagaatggaagttggaagctagaaaaagcatccctcatagaggtgaaaacctgcacatggccaaaatcacacactctttggagcaatggtgtgctagagagtgacatgattatcccaaagagtctagctggtcccatttcgcaacacaaccacaggcccgggtaccacacccaaacggcaggaccctggcacttaggaaaattggagctggacttcaactattgtgaaggaacaacagttgtcatctcagaaaactgtgggacaagaggcccatcattgagaacaacaacagtgtcagggaagttgatacacgaatggtgttgccgctcgtgcacacttcctcccctgcgatacatgggagaagacggctgctggtatggcatggaaatcagacccattaatgagaaagaagagaacatggtaaagtctctagcctcagcagggagtggaaaggtggacaacttcacaatgggtgtcttgtgtttggcaatcctctttgaagaggtgatgagaggaaaatttgggaaaaaacacatgattgcaggggttctcttcacgtttgtgctcctcctctcagggcaaataacatggagagacatggcgcacacactcataatgattgggtccaacgtctctgacagaatggggatgggcgtcacttacctagctctaattgcaacatttaaaattcagccattcttggctttgggattcttcctgaggaaactgacatctagagaaaatttattgctgggagttgggttggccatggcagcaacgttacgactgccagaggacattgaacaaatggcgaatggaattgctttggggctcatggctcttaaactgataacacaatttgaaacataccaactatggacggcattagtttccctaacgtgttcaaatacaattttcacgttgactgttgcctggagaacagccactctgattttagccggaatttcgcttttgccagtgtgccagtcttcgagcatgaggaaaacagattggctcccaatgactgtggcagctatgggagttccacccctaccactttttattttcagtctgaaagatacactcaaaaggagaagctggccactgaatgagggggtgatggcagttggacttgtgagcattctagctagttctctccttaggaatgatgtgcccatggctggaccattagtggctgggggcttgctgatagcgtgctacgtcataactggcacgtcagcagacctcactgtagaaaaagcagcagatgtaacatgggaggaagaggccgagcaaacaggagtgtcccacaatttaatgatcacagttgatgatgatggaacaatgagaataaaagatgacgagactgagaacatcttaacagtgcttttaaaaacagcactactaatagtatcaggcatctttccatactccatacccgcaacactgttggtctggcatacttggcaaaagcaaacccaaagatccggcgtcctatgggacgtacccagccccccagagacacagaaagcggaactggaagaaggggtctataggatcaaacagcaaggaatttttgggaaaacccaagtgggggttggagtacagaaagaaggagttttccacaccatgtggcacgtcacaagaggggcagtgttgacacacaatgggaaaagactggaaccaaactgggctagcgtgaaaaaagatctgatttcatacggaggaggatggagattgagtgcacaatggcaaaagggggaggaggtgcaggttattgccgtagagcctgggaagaacccaaagaactttcaaaccatgccaggcatttttcagacaacaacaggggaaataggagcaattgcactggatttcaagcctggaacttcaggatctcccatcataaacagagagggaaaggtagtgggactgtatggcaatggagtggttacaaagaatggaggctatgtcagtggaatagcgcaaacaaatgcagaaccagatggaccgacaccagagttggaagaagagatgttcaaaaagcgaaatctaaccataatggatcttcatcctgggtcaggaaagacgcggaaatatcttccagctattgttagagaggcaatcaagagacgcttaaggactctaattttggcaccaacaagggtagttgcagctgagatggaagaagcattgaaagggctcccaataaggtatcaaacaactgcaacaaaatctgaacacacaggaagagagattgttgatctaatgtgtcacgcaacgttcacaatgcgcttgctgtcaccagtcagggttccaaactacaacttgataataatggatgaggctcatttcacagacccagccagtatagcggctagagggtacatatcaactcgtgtaggaatgggagaggcagccgcaattttcatgacagcaacaccccctggaacagctgatgcctttcctcagagcaacgctccaattcaagatgaagagagagacataccggaacgctcatggaattcaggcaatgaatggattactgactttgttgggaagacagtgtggtttgtccctagcatcaaagccggaaatgacatagcaaactgcttgcggaaaaatggaaaaaaggtcattcaactcagcaggaagacctttgacacagaatatcaaaagaccaaactgaatgattgggactttgtggtgacaacagacatttcagaaatgggagccaatttcaaagcagatagagtgatcgacccaagaagatgtctcaagccggtgattttgacagatggacccgagcgggtgatcctggctggaccaatgccagtcaccgtagcgagcgctgcgcaaaggagagggagagttggcaggaacccacaaaaagaaaatgaccagtacatattcatgggccagcctctcaacaatgatgaagaccatgctcactggacagaagcaaaaatgctgctggacaacatcaacacaccagaagggattataccagctctctttgaaccagaaagggagaagtcagccgccatagacggcgaataccgcctgaagggtgagtccaggaagactttcgtggaactcatgaggaggggtgacctcccagtttggctagcccataaagtagcatcagaagggatcaaatatacagatagaaaatggtgctttgatggagaacgtaataatcaaattttagaggagaatatggatgtggaaatctggacaaaggaaggagaaaagaaaaaactgagacctaggtggcttgatgcccgcacttattcagatcctttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacgatggaaacactcttactcctgggactgatgatcttgttaacaggtggagcaatgctcttcttgatatcaggtaaagggattggaaagacttcaataggactcatttgtgtaattgcttccagcggcatgttatggatggctgatgtcccactccaatggatcgcgtcggctatagtcctggagttttttatgatggtgttgctcataccagaaccagaaaagcagagaactccccaagacaaccaactcgcatatgtcgtgataggcatacttacattggctgcaatagtagcggccaatgaaatgggactgttggaaactacaaagagagatttaggaatgtctaaagaaccaggtgttgtttctccaaccagctatttggatgtggacttgcacccagcatcagcctggacattgtacgccgtggccacaacagtaataacaccaatgttgagacacaccatagagaattccacagcaaatgtgtccctggcagccatagctaaccaggcagtggtcctgatgggtttagacaaaggatggccgatatcgaaaatggacttgggcgtaccactattggcactgggttgctattcacaagtgaacccactaactcttgcagcggcagtacttttgctagtcacacattatgcaattataggtccaggattgcaggcaaaagccactcgtgaagctcaaaaaaggacagctgctggaataatgaagaatccaacggtggatggaataatgacaatagacctagatcctgtaatatatgattcaaaatttgaaaagcaactaggacaggttatgctcctggttctgtgtgcagttcaacttttgttaatgagaacatcatgggccttgtgtgaagttctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaaccttaggagaaaagtggaaaaagaaattaaatcagttatcccggaaagagtttgacctttacaagaaatccggaatcaccgaagtggatagaacagaagccaaagaagggttaaaaagaggagaaataacacaccatgccgtgtccagaggcagcgcaaaacttcaatggttcgtggagagaaacatggtcattcccgaaggaagagtcatagacttaggctgtggaagaggaggctggtcatattactgtgcaggactgaaaaaagttacagaagtgcgaggatacacaaaaggcggcccaggacacgaagaaccagtacctatgtctacatacggatggaacatagtcaagttaatgagtggaaaggatgttttttatctgccacctgaaaagtgtgataccctattgtgtgacattggagaatcttcaccaagcccaacagtggaagaaagcagaaccataagagtcttgaagatggttgaaccatggctaaaaaacaaccagttttgcattaaagtattgaacccatacatgccaactgtgattgagcacttagaaagactacaaaggaaacatggaggaatgcttgtgagaaatccactctcacgaaactccacgcacgaaatgtattggatatccaatggtacaggcaacatcgtctcttcagtcaacatggtatccagattgctactgaacagattcacaatgacacacaggagacccaccatagagaaagatgtggatttaggagcaggaacccgacatgtcaatgcggaaccagaaacacccaacatggatgtcattggggaaagaataaaaaggatcaaagaggagcatagttcaacatggcactatgatgatgaaaatccttacaaaacgtgggcttaccatggatcctatgaagtaaaagccacaggctcagcctcctccatgataaatggagtcgtgaaactcctcacaaaaccatgggatgtggtgcccatggtgacacagatggcaatgacagatacaactccatttggccagcaaagagtttttaaagagaaagtggacaccaggacacctaggcccatgccaggaacaagaaaggttatggagatcacagcggagtggctttggaggaccctgggaaggaacaaaagacccagattatgcacaagggaggagttcacaaagaaggtcagaaccaacgcagctatgggcgctgtcttcacagaagagaaccaatgggacagtgcgagagctgctgttgaggacgaagaattttggaaacttgtggacagagaacgtgaactccacaaactgggcaagtgtggaagctgcgtttacaacatgatgggcaagagagagaaaaaacttggagagtttggtaaagcaaaaggcagtagggctatatggtacatgtggttgggagccaggtaccttgagttcgaggcgctcggattcctcaatgaagaccattggttctcgcgtgaaaactcttacagtggagtagaaggagaaggactgcacaagctgggatacatcttgagagatatttccaagatacccggaggagccatgtatgctgatgacacagccggttgggacacaagaataacagaagatgacctgcacaatgaggaaaaaatcacacagcagatggaccctgaacacaggcagctagcgaacgctatattcaagctcacataccaaaacaaagtggtcaaagtccaacgaccaactccaaagggcacggtaatggacatcatatctaggaaagaccaaagaggcagtggacaggtgggaacttatggtctgaacacattcaccaacatggaagcccagctaatcagacaaatggaaggagaaggcgtgttgtcaaaggcagacctcgagaacccccatccgctagagaagaaaattacacaatggttggaaactaaaggagtggagaggttaaaaagaatggccatcagcggggatgattgcgtagtgaaaccaatcgacgacagattcgccaatgccctgcttgccctgaacgatatgggaaaggttaggaaggacatacctcaatggcagccatcaaagggatggcatgattggcaacaggtccctttctgctcccaccactttcatgaattgatcatgaaagatggaagaaagttggtagttccctgcagaccccaggacgaactaataggaagagcgagaatctctcaaggagcaggatggagccttagagaaactgcatgtctagggaaagcctacgctcaaatgtggactctcatgtattttcacagaagagatcttagactagcatccaacgccatatgttcagcagtaccagtccattgggtccccacgagcagaacgacatggtctattcatgctcaccatcagtggatgactacagaagacatgcttactgtctggaacagggtgtggatagaggacaatccatggatggaagacaaaactccagtcacaacgtgggaagatgttccatatctagggaagagagaagaccaatggtgcggatcactcataggtctcacttccagagcaacctgggcccagaacatactcacagcaatccaacaggtgagaagcctcataggcaatgaagagtttctggactacatgccttcgatgaagagattcaggaaggaggaggagtcagagggagccatttggtaa

SEQ ID NO: 7698 - RNA, 9873 nt, synthetic construct
  misc_feature 1..9873: note = derived and/or modified CDS sequence (wt) from DENV-3__JQ045687__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacagtcacttacaaatgccccctcgttgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaagccacccaactggcgaccctaaggaagttatgcattgagggaaaaattaccaacataacaactgactcaaggtgtcctacccaaggggaagcgattctacctgaagagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcagtggttctttgacctacccctaccatggacatcaggagctacaacagagacaccaacttggaacaagaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccctgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaatcaactggtacaagaagggaagctcaattgggaagatgttcgaggccactgccagaggtgcaaggcgcatggccatcttgggagacacagcctgggactttggttcagtgggtggtgttctaaattcactaggtaaaatggtgcaccaaatattcggaagtgcttacacagccctgtttagtggagtctcatggataatgaaaattggaataggtgtcctcttaacctggatagggttaaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactccccgaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccacaggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacataaccacaggcctgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagctgatacacgaatggtgttgccgctcgtgcacacttcctccattacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcactctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattttagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaaatgttcaaaaagcgaaatctaaccacaatggatcttcatcctgggtcaggaaagacgcggaaatatcttccagccatcgtcagagaagcaatcaagagacgtttaagaactctaattttggcaccaacaagagtagttgcagctgagatggaagaagcactgaaaggactcccaataaggtatcaaacaactgcaacaaaatctgaacacacaggaagggagattgttgatctaatgtgccacgcaacattcacaatgcgtttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggacattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctcttaataatgacgaagaccatgctcactggacagaagcaaaaatgctgctagacaacatcaacacaccagaagggatcataccagctctctttgaaccagagagggagaagtcagccgctatagatggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactagcactgggctgctattcacaagtgaacccactgactctcacagcggcagtacttctgctagttacacattatgccattataggtccaggattgcaggctaaagccactcgtgaggctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttgggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggttgtggaagaggaggctggtcatattattgcgcaggactgaaaaaagtcacagaagtgcgaggatacacaaaaggtggcccaggacacgaagaaccagtacctatgtccacatacggatggaacatagtcaagctaatgagtggaaaggatgtgttttatcttccacctgagaagtgtgacaccctattgtgtgacattggagaatcatcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaatatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtagttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatattcaagctcacatatcaaaacaaagtggtcaaagttcaacgaccaactccaaaaggcacggtaatggacatcatatctagaaaagaccaaaggggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggatatacctcaatggcagccatcaaaggggtggcatgattggcaacaagtccctttctgctcccaccactttcatgaactgatcatgaaagatggaagaaagttggtggttccctgcagaccccaggacgaactgataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtgccggtccattggatccccacaagcagaacgacatggtctattcacgctcaccatcagtggatgaccacagaagacatgctaactgtttggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7699 - RNA, 9873 nt, synthetic construct
  misc_feature 1..9873: note = derived and/or modified CDS sequence (wt) from DENV-3__JQ045689__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgctggctccccatgttggcatgggactggacacacgtacccaaacttggatgtcggctgaaggagcttggagacaatttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgttggacatagagcttcagaagaccgaggccacccaactggcgaccctaaggaagttatgcattgagggaaaaattaccaacataacaactgactcaaggtgtcctacccagggggaagcgattctacctgaagagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgttttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcatttgaaatgtagacttaagatggacaaattggaactcaaggggatgagctatgcaatgtgcttgaatacttttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcgtgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaaggacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtctttacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggttgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacatacactcataatgattgggtccaacgcttctgacaggatgggaatgggcgttacctacttagctttaattgcaacattcaaaatccagccattcttggccttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcacgctgactgttgcctggagaacagccaccttgattctggccggagtttcacttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcactactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaacggtggctacgtcagtggaatagcgcaaacaaatgcagaaccagacggaccgacaccggaattagaagaagaaatgttcaaaaagcgaaatctaaccataatggatctccatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaaccgcaacaaaatctgaacacacaggaagggagattgttgatctaatgtgccacgcaacattcacaatgcgcttgctatcaccagtcagggttccaaattacaatttgataataatggatgaggcccatttcacagatccagctagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatggaaaaaaggtcatccaacttagcagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccacgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaaatcaattgcccttgatcttgtgacagaaataggaagagtgccttcacacttagcccacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggagtcgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaagtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttgggagaaaagtggaaaaagaaattaaatcagttatcccggaaagagtttgatctttataagaaatctggaatcactgaagtggatagaacagaagccaaagaagggttgaaaagaggagaaacaacacatcatgccgtgtccagaggcagcgcaaaacttcaatggttcgtggagaggaacatggtcactcccgaaggaagagtcatagacttaggctgtggaagaggaggctggtcatattactgcgcaggactgaaaaaagttacagaagtgcgaggatacacaaaaggtggcccaggacatgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaatatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttgagagatatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagacctcaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatattccatacctagggaagagagaagatcaatggtgcggatcacttattggtctcacctccagagcaacatgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7700 - RNA, 9873 nt, synthetic construct
  misc_feature 1..9873: note = derived and/or modified CDS sequence (wt) from DENV-3__JQ045691__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatattggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctagtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagacagaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcaaaatttcaatgtctagaaccaatagagggaaaagtggtgcaatatgagaatcttaaatacactgtcatcatcacagtgcacacaggagaccaacaccaagtgggaaatgatacgcagggagtcacggttgagataacaccccaggcatcaaccgttgaagccatcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaatctcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagctcacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacttggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaacttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaagaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagagaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattactgactttgttggaaagacggtgtggtttgtacctagcattaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagagatgggagccaattttaaagcagatagagtgattgacccaagaagatgtctcaagccagtaattttgacggatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttccttctatcaggtaaagggattggaaagacttcaataggactcatttgtgttatagtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaattactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacccatgtccacatacggatggaacctagtcaagctaatgagtggaaaggacgtgttttatcttccacctgagaagtgtgacaccctattgtgtgacattggagaatcttcaccaagttcaacagtggaagaaagcagaaccataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaattccacgcatgaaatgtactggatatccaatggtaccggcaacatcgtctcttcagtcaacatggtatccagattgctactgaacagatttacgatgacacacaggagacccaccatagagaaagatgtggacttgggagcaggaactcgacatgtcaatgcggaaccagaaacacccaacatggacgtcattggagaaagaataaaaaggatcaaggaggagcatagttcaacatggcactatgatgatgaaaatccttacaaaacatgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccagggccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcacttggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccagagaggcagtggacaggtggggacttatggtctgaacacattcaccaacatggaagcccagttggtcagacagatggaaggagaaggcgtgttgtcgaaggcagacctcgagaactctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggtcaggaaggacatacctcaatggcagccatcaaaggggtggcatgattggcaacaggtccctttctgctcccaccactttcatgaactgatcatgaaagatggaagaaagctggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatctggtaa

SEQ ID NO: 7701 - RNA, 9873 nt, synthetic construct
  misc_feature 1..9873: note = derived and/or modified CDS sequence (wt) from DENV-3__JQ045692__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactagacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctagtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagacagaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaatcttaaatacactgtcatcatcacagtgcacacaggagaccaacaccaagtgggaaatgatacgcagggagtcacggttgagataacaccccaggcatcaaccgttgaagccatcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaatctcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagctcacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaacttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaacgatgtgcccatggctggaccactagtggccgggggcttgttgatagcgtgctatgtcataactggcacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaagcacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcattaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagagatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaggggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaacaatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtggaggaactaccagaaacaatggaaacattcctactcttgggactcatgatcttattaacaggtggagcaatgcttttccttctatcaggtaaagggattggaaagacttcaataggactcatttgtgttatagtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggcgttgtttctccaaccagctatttagatgtagacttgcacccagcatcagcctggacattgtacgccgtggccacaacagtaataacaccaatgttgagacacaccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaattactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgatattggagaatcttcaccaagttcaacagtggaagaaagcagaaccataagagtcttgaagatggttgagccatggctaaaaaacaaccagttttgcattaaagtattaaacccttacatgccaactgtgattgagcacctagaaagattacaaagaaaatatggaggaatgcttgtgagaaatccactctcacgaaattccacgcatgaaatgtactggatatccaatggtaccggcaacatcgtctcttcagtcaacatggtatccagattgctactgaacagatttacgatgacacacaggagacccaccatagagaaagatgtggacttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccagggccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaagaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcacttggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccagagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggtcaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatctggtaa

SEQ ID NO: 7702 - RNA, 9873 nt, synthetic construct
  misc_feature 1..9873: note = derived and/or modified CDS sequence (wt) from DENV-3__JQ045694__SS-prME
  source 1..9873: mol_type = other RNA
acatcgctctgcctcatgatgatgttaccagcaacacttgctttccatctgacttcacgcgatggagagccgcgcatgattgtggggaagaatgaaagagggaaatccttactttttaagacagcttctggaatcaacatgtgcacactcatagccatggacttgggagagatgtgtgatgacacggtcacttataaatgccccctcattgccgaagtggaacctgaagacattgattgctggtgcaaccttacatcgacatgggtgacctatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccaaggggaagcgattctacctgaggagcaggatcagaactacgtgtgtaagcacacatacgtggatagaggttggggaaacggttgtggtttgtttggaaaaggaagcttggtgacatgcgcgaaatttcaatgtctagaaccaatagagggaaaagtggtgcagtatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttttttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcctgaatacctttgtgttgaagaaagaagtctctgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcccgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctgaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtctttacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagacatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctgaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaagaaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaacttgatgatcacagttgatgatgatggaacaatgagaataaaggatgatgagactgagaacattctaacagtgctcttaaaaacagcattactgatagtatcaggcatctttccatactccatacctgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcattttccagacaacaacgggggaaataggagcaattgcactagacttcaagcctggaacttcaggatctcctatcataaacagagagggaaaggtagtgggactgtatggcaatggagtggtcacgaaaaatggtggctacgtcagtggaatagcgcaaacaaatgcagaaccagacggaccgacaccggaattggaagaagaaatgttcaaaaagcgaaacctgaccataatggatcttcatcctgggtcaggaaagacgcggaaataccttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccaatcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatggaaaaaaggtcatccaacttagtagaaagacttttgacacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggtcagcctctcaacaatgatgaagaccatgcccactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaagagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatgtcaggtaaagggattggaaagacttcaataggactcatttgtgttattgtttccagtggcatgttatggatggctgatgtcccacttcaatggatcgcgtcggctatagtcctggaatttttcatgatggtgctgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacactgtacgccgtggccacaacagtaataacaccaatgttgagacacaccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacggcggcagtacttctgctagttacacattatgccattataggtccaggattgcaggctaaagccactcgtgaagctcaaaaaagaacagctgctggaataatgaagaatccaacggtggatgggataatgacaatagatctagatcctgtaatatacgattcgaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggccaacatttttagagggagctacttagcaggagctgggcttgctttttctatcatgaaatcagttggaacaggaaggagaggaacggggccacaaggtgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaggtgcgaggatacacaaaaggtggcccaggacacgaagaaccagtacccatgtctacatacggatggaacctagtcaagctaatgagtggaagggacgtgttttatcttccacctgagaagtgtgacaccctattgtgtgacattggagaatcttcaccaagcccaacagtggaagaaagcagaactataagagtcttgaagatggttgagccatggctaaaaaacaaccaattttgcattaaagtattaaacccttacatgccaactgtgattgagcacctagaaagattacaaagaaaatatggaggaatgcttgtgagaaacccactctcacgaaactctacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacatttaccaacatggaagcccagttggtcagacagatggaaggagaaggcgtgttgtcgaaggcagacctcgagaaccctcatctactagagaagaaaatcacacaatggctggaaaccgaaggagtggagagattaaaaagaatggccatcagcggagatgattgcgtggtgaaaccgattgacgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaaccgtctggaacagggtgtggatagaggacaatccatggatggaagacaaaaccccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7703 - RNA, 9873 nt, synthetic construct
  misc_feature 1..9873: note = derived and/or modified CDS sequence (wt) from DENV-3__GU363549__SS-prME
  source 1..9873: mol_type = other RNA
acatcgctctgtctcatgatgatattgccagcagcacttgctttccacttgacttcacgagatggagagccgcgcatgatcgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggccctcaggcacccagggttcaccatactagccctatttcttgcccattacataggcacctccttgacccagaaggtggttatttttatactactaatgctggtcaccccatccatgacaatgagatgtgtgggagtgggaaacagggattttgtggaaggtctgtcaggagctacatgggttgacgtggtgctagagcacggggggtgtgtgaccaccatggctaagaacaagcccacgctggatatagagcttcagaagaccgaggccacccaactggcgaccctaaggaagctatgcattgaggggaaaattaccaacataacaactgactcaagatgccccacccaaggggaagcggttttgcctgaggagcaggaccagaactacgtgtgtaagcatacatacgtagacagaggctgggggaacggttgtggtttgtttggcaagggaagcttggtaacatgtgcgaaatttcaatgcctggaaccgatagagggaaaagtggtgcaatatgagaacctcaagtataccgtcatcattacagtgcacacaggagaccaacaccaggtgggaaatgaaacgcagggagtcacggctgagataacgcctcaggcatcaaccactgaagccatcttgcctgaatatggaacccttgggctagagtgctcaccacggacaggtttggacttcaatgaaatgatcttactaacaatgaagaataaagcatggatggtacacagacaatggttttttgacctacctctaccatggacatcaggagctacaacagaaacaccaacttggaacaggaaggagctccttgtgacattcaaaaacgcacatgcgaaaaaacaagaagtagttgtccttggatcacaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcggaaacgcagcatgggacaatactcattaaggtcgagtacaaaggggaagatgcaccttgcaagattcctttctccacagaggatgaacaagggaaagctcacaatggcagactgatcacagccaacccagtggtgactaagaaggaggagcctgttaacattgaggctgaacctccttttggggaaagtaatatagtaattggaattggagacaatgccttgaaaatcaactggtacaagaagggaagctctattgggaagatgttcgaggctactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcctgggtgatgaaaattggaataggtgttctcttgacttggatagggttgaattcaaaaaacacatccatgtcattttcatgcattgcgataggaatcatcacactctatctgggagcagtggtacaagctgacatggggtgtgtcataaactggaaaggcaaagaacttaaatgcggaagtggaattttcgtcaccaacgaggtccatacctggacagagcagtacaaattccaagcggattccccaaaaagattggcgacagctattgcaggcgcttgggaaaatggagtgtgcggaattaggtcaacaaccagaatggagaatctcttgtggaagcagatagccaatgaactgaactacatattatgggaaaataatattaaattaacggtagttgtgggcgacacaattggggtcttggagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaactaacatatggctgaaactccgagaggtgtacacccaaatgtgtgaccacaggctaatgtcggcagccgtcaaggatgagagggccgtgcatgccgacatgggctattggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaaaattggagctggacttcaactattgtgaaggaacaacagttgtcatcacagaaaactgtgggacgagaggcccatcattgagaacaacgacagtgtcaggaaagttgatacacgaatggtgttgccgctcgtgcacacttcctcctctgcgatacatgggagaagacggctgttggtatggtatggaaatcagacccatcagtgagaaagaagagaacatggtaaagtctttagtctcagcgggaagtggaaaggtagacaatttcacaatgggtgtcttgtgcttggcaatcctctttgaagaggtgatgagaggaaaatttgggaagaaacacatgattgcaggggttttcctcacgtttatgctccttctctcagggcaaataacatggagagacatggcgcacacactaataatgattgggtccaacgcctctgacaggatgggaatgggcgtcacctatctagctttaattgcaacatttaaaatccagccattcctggctttgggatttttcctaagaaaactgacatctagagagaatttactgttaggagttggattggctatggcaacaacgatacaactgccagaggacattgaacaaatggcaaatggaatcgccctagggctcatggctcttaaattgataacacaatttgaaacataccaattatggacagcattaatctccttaacgtgttcaaatacaattttcacgttgactgttgcctggagaacagccaccctgattttggccggagtttcacttttaccagtgtgccagtcttcgagcatgaggaaaacagactggcttccaatgacagtggcagctatgggagtcccacccctaccactctttatttttagcttgaaagacacactcaaaaggagaagctggccactgaatgaaggggtgatggctgttgggcttgtgagcattctggccagttctctccttagaaatgacgtgcccatggctggaccattagtggccgggggcttgttgatagcgtgctacgtcataactggcacgtcagcagaccttacagtagaaaaagcagcagatgtaacatgggaggaagaggctgagcaaacaggagtgtcccacaacttaatgatcacagttgatgatgatggaacaatgagaataaaagatgatgagactgagaatattctgacagtgcttttgaagacagcattactaatagtatcaggtatctttccatactccatacccgcaacattgttggtctggcatacttggcaaaagcaaacccaaagatccggtgttttatgggacgtacccagccccccagagacacagaaagcagaactggaagaaggggtctataggatcaaacagcaaggaattcttgggaaaacccaagtaggggttggagtacaaaaagaaggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacatttcagaccacaacaggggaaataggagcaattgcactggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaagcgaaatctaaccataatggatcttcatcctgggtcaggaaagacacggaaataccttccagccattgttagagaggcaatcaagagacgtttaagaactctaattttggcaccgacaagggtggttgcagctgaaatggaagaagcattgaaagggctcccaataaggtaccaaacaacagcaacaaaatctgaacacacgggaagagagattgttgatctaatgcgccacgcaacgttcacgatgcgcttgctgtcaccagttagggttccaaattacaacttgataataatggatgaggcccatttcacagacccagccagtatagcggccagagggtacatatcaactcgtgttggaatgggagaggcagccgcaattttcatgacggcaacgccccctggaacagctgatgcctttcctcagagcaacgctccaattcaagatgaagaaagggacataccagaacgctcatggaattcaggcaatgaatggattaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgattgggactttgtggtgacaactgacatttcagaaatgggggccaatttcaaagcagatagagtgatcgacccaagaagatgtctaaaaccagtgatcctgacagatggaccagagcgggtgatcctggctggaccaatgccagtcaccgtggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacatcaacactccagaaggaatcataccagctctctttgaaccagaaagggagaagtcagccgccatagacggtgaatatcgcctgaagggtgaatccaggaagactttcgtggaactcatgaggaggggtgaccttccagtttggttagctcacaaagtagcatcagaagggatcaaatacacagatagaaaatggtgctttgatggacagcgtaacaatcaaattttagaggaaaacatggacgtggaaatctggacaaaggaaggagaaaagaaaaaattaagacctaggtggcttgatgcccgcacttattcagatcccttagcactcaaggaattcaaggactttgcggctggcagaaagtcaatcgcccttgatcttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgcttttcttgatatcaggtaaagggattggaaagacttcaataggactcatttgtgtgattgcttccagcggcatgctgtggatggccgaaatcccactccaatggatcgcgtcggctatagtcctggagttttttatgatggtgttgcttataccagaaccagaaaagcagagaaccccccaagacaaccaactcgcatatgtcgtaataggcatacttacattggctgcaataatagcggccaatgaaatgggactgttggaaactacaaagagagatttaggaatgtctaaggagccaggtgttgtttctccaactagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactattggcattgggttgctattcacaagtgaacccattgactctaacagcggcagtacttttgctagttacacattatgctattataggtccaggactgcaggcaaaagccactcgtgaagctcaaaaaaggacagctgctggaataatgaagaatccaacggtggatgggataataacaatagacctagatcctgtaatatatgattcaaaatttgaaaagcaactgggacaggtcatgctcctggttttgtgtgcagttcaactgttgttaatgagaacatcatgggccttgtgtgaagccctaactttagctacaggaccaataacaacactctgggaaggatcacctgggaagttctggaataccacgatagctgtttccatggcgaacatttttagagggagctatttagcaggagctgggcttgccttttctattatgaaatcagttggaacaggaaaaagaggaacaggctctcaaggtgaaactttgggagaaaaatggaaaaagaaactgaatcaattatcccggaaagagtttgacctttacaagaagtctggaatcactgaagtggatagaacagaagccaaagaagggttgaaaagaggagaaacaacacatcatgccgtgtccagaggtagtgcaaaacttcaatggtttgtggagagaaacatggtcattcccgaaggaagagtcatagacctgggctgtggaagaggaggctggtcatattactgtgcaggactgaaaaaagtcacagaagtgcgaggatacacaaaaggcggtccaggacacgaagaaccagtgcctatgtcaacacatggatggaacatagttaagttaatgagtggaaaggatgtgttttatcttccacctgaaaagtgtgacaccctgttgtgtgacattggagaatcctcaccaagcccaacagtggaagaaagcagaactataagagttttgaagatggttgaaccatggctgaaaaacaaccagttttgcattaaagtattgaacccttacatgccagccgtgattgagcacctagagagactacaaaggaaacacggaggaatgcttgtgagaaatccactttcacgaaactccacgcacgaaatgtactggatatctaatggtacaggtaacattgtctcttcagtcaacatggtatccagactgttactgaacaggttcacgatgacacacaggagacctaccatagagaaagatgtggacttaggagcaggaactcgacatgttaatgcggaaccagaaacacccaacatggatgtcattggggaaagaataagaaggatcaaggaggagcataattcaacatggcactatgatgacgaaaacccctacaaaacgtgggcttaccacggatcttatgaagtcaaggccacaggctcagcctcctccatgataaatggagtcgtgaaacttctcactaaaccatgggatgtggtgcccatggtgacacagatggcaatgacagatacaactccatttggccagcagagagtttttaaagagaaagtggacaccaggacacccaggcctatgccagggacaagaaaggttatggagatcacagcggagtggctctggagaaccctgggaaggaacaaaagacccaggttatgcacaagggaagagtttacaaaaaaggtcagaaccaacgcagccatgggtgccgttttcacagaggagaaccaatgggacagtgcgaaagctgctgttgaggatgaagaattttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgaaaactcctacagtggagtagaaggagaaggactgcacaagctaggctacatattaagggacatttccaagatacccggaggagccatgtatgctgatgacacagctggttgggacacaagaataacagaagatgacctgcacaatgaggaaaagatcacacagcaaatgaaccctgaacacaggctgttagcgaacgctatatttaagctcacataccaaaacaaagtggtcaaagttcaacgaccgactccaacgggcacggtaatggacatcatatctaggaaagaccaaagaggcagtggacaggtgggaacttatggtctaaatacatttaccaacatggaagcccagttagtcagacaaatggaaggagaaggtgtgctgtcaaaggcagacctcgagaaccctcatctgccagaaaagaaaattacacaatggttggaaaccaaaggagtggagaggttaaaaagaatggccattagcggggatgattgcgtagtgaaaccaattgatgacaggttcgctaacgccctgcttgctctgaacgatatgggaaaggttcggaaagacatacctcaatggcagccatcaaagggatggcatgactggcagcaggttcccttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctatgcccaaatgtggagtctcatgtattttcacagaagagatctcagactagcgtccaatgccatatgttcagcagtaccagtccactgggtccccacaagtagaacgacatggtctattcatgctcaccatcagtggatgactacagaagacatgcttactgtttggaacagggtgtggatcgaggacaatccatggatggaagacaaaactccagttacaacctgggaaaatgttccatacctagggaagagagaagaccaatggtgcggatcacttattggtctcacttccagagcaacctgggcccagaacatatccacagcaattcaacaggtgagaagccttataggcaatgaagagtttctggactacatgccttcaatgaagagattcaggaaggaggaggagtcggagggagccatttggtaa

SEQ ID NO: 7704 - RNA, 9873 nt, synthetic construct
  misc_feature 1..9873: note = derived and/or modified CDS sequence (wt) from DENV-3__KJ622197__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacggcttctggaatcaacatgtgtacactcatagccatggacttaggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtagcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttatactactaatgctggtcactccatccatggctatgagatgcgtgggagtaggaaacagagattttgtggaaggtctgtcgggagctacatgggttgatgtggtgctcgagcacggtgggtgtgtgaccaccatggctaagaacaagcccacgctggacatagagcttcagaagaccgaggccactcaactggcgaccctaaggaaattatgcattgaggggaaaataaccaacataacaactgactcaaggtgtcctacccagggggaagcgattttacctgaggagcaggaccagaactacgtatgtaagcacacttacgtggatagaggttggggaaacggttgtggtttgtttggaaaaggaagtttggtgacatgcgcaaaatttcaatgtctagaatcaatagagggaaaagtggtgcaacatgagaacctcaaatacactgtcaccattacagtgcacacaggagaccaacaccaggtgggaaatgacacgcagggagtcacagctgagataacaccccaggcatcaaccgttgaagctatcctgcctgaatatggaacccttgggctagaatgttcaccacgcacaggtttggatttcaatgaaatgattctattgacaatgaagaataaagcatggatggtacatagacaatggttttttgacctacccctaccatggacatcaggagctataacagagacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatttttgcggggcacttgaaatgcagactcaagatggacaaattggaactcaaggggatgagctatgcaatgtgcttgaatacctttgtgttaaagaaagaagtctctgaaacgcagcatgggacaatactcattaaggttgaatacaaaggggaagatgcaccttgcaagattcccttctccacagaggatggacaagggaaagcccacaatggtagactgatcacagccaacccagtggtgaccaagaaggaggagcctgtcaacattgaggctgaacctccttttggggaaagtaacatagtgatcggaattggagacaaagccttgaaaatcaactggtacaagaagggaagctcgatcgggaagatgttcgaggccactgccagaggtgcaaggcgcatggccatcttgggagacacagcctgggactttggatcagtgggtggcgttctaaattcattagggaaaatggtgcaccaaatattcggaagtgcttacacagccctgtttggtggagtctcatggataatgaaaattggaataggtgttcttttaacctggatagggttgaattcaaaaaacacttccatgtcattttcatgcattgtgataggaataatcacactctatctgggaactgtggtacaagctgacatggggtgtgtcataaactggaaaggaaaagaactcaaatgtggaagtggaatctttgtcaccaatgaggtccacacctggacagagcaatacaaatttcaagcagactcccctaaaagactggcgacggccattgcaggcgcttgggaaaatggagtctgcggaatcaggtcgacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgacagctgaaatacaaaattcttctttcataatagatgggccaaacacaccggagtgtccaagtgcctcaagagcatggaatgtgtgggaggtggaagattacgggtttggagttttcacaaccaacatatggctgaaactccgagaggtgtacacccaaacatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgattatcccaaagagtctagccggtcccatttcgcaacacaaccacaggcccgggtaccacacccaaacggcaggaccctggcacttgggaaaattggaactggacttcaactattgtgaaggaacaacagtagtcatcacagaaaactgtgggacaagaggcccatcactgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtctggcaatcctcttcgaagaggtgatgagaggaaaatttgggaaaaagcacatgattgcaggggttctcctcacgtttatgctccttctctcagggcagataacatggagagatatggctcacacactcataatgattgggtccaacgcttctgacaggatgggaatgggtgttacctacctagctttaatagcaacattcaagattcagccattcttggctttgggattctttctaaggaaattgacatccagagaaaatttgctgttgggagttggattggccatggcaacaacgctacaactgccagaggacattgaacaaatggcgaatggaatcgctctggggctcatggctctaaaactgataacacaatttgagacataccagttatggacggcattagtctccctaacgtgttcaaacacaattttcacgttgactgttgcctggagaacagccaccttgattctggccggagtttcgctattgccagtgtgccagtcttcgagcatgaggaaaacagattggctcccagtggctgtggcagctatgggagttccacccttaccactttttatcttcagtttgaaagatacactcaaaaggaggagctggccactgaatgagggggtgatggctgttggccttgtgagcattctagctagttctctccttaggaatgacgtgcccatggctggaccactagtggctgggggcttgctgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaagatgatgagactgagaacatcctaacagtgctcttaaaaacggcattactaatagtatcaggcatctttccatactcaatacccgccacattgttggtctggcatacttggcaaaagcaaacccaaagatctggtgttctatgggatgtacccagccccccagaaacacagaaagcagaactggaagagggggtctacaggatcaaacaacaaggaatctttggaaaaacccaagtgggggttggagtacagaaagaaggagtcttccacaccatgtggcacgttacaagaggggcagtgttgacgcacaatgggaaaagactggaaccaaactgggccagcgtgaaaaaagacctgatttcatacggaggaggatggagattgagtgcacaatggcaaaagggagaggaagtgcaggttattgccgtagagcctgggaggaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtagttacaaaaaatggtggctacgtcagtggaatagcgcaagcaaacgcagaaccagacggaccgacaccggaattggaagaagaaatgtttaaaaagcgaaatctaaccataatggatcttcatcctgggtcaggaaagacgcggaaatatctcccagccattgtcagagaagcaatcaagagacgcttaagaactttaattttggcaccaacaagagtggttgcagctgagatggaagaagcattgaaaggactcccaataaggtatcaaacaactgcaacaaaatctgaacacacaggaagggagattgttgacctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaatcttcatgacagcaacaccccctggaacagccgaagcctttccccagagcaacgctccaattcaagatgaagaaagggacattccggaacgctcatggaattcaggcaatgaatggattaccgactttgttgggaagacggtgtggtttgtccctagcatcaaagccggaaatgacatagcaaactgcttgcggaaaaatgggaaaaaggtcattcaactcagtaggaagacttttgacacagaatatcaaaaaaccaaactgaatgattgggacttcgtggtgacaacagacatttcagaaatgggagccaactttaaagcagatagagtgatcgacccaagaagatgtctcaagccagtgattttgacagatggacctgagcgggtgattttggctggaccaatgccagtcactgcagcgagtgctgcgcaaaggagagggagagtcggcaggaatccacaaaaagaaaatgatcagtacatattcacgggtcagcctctcaacaatgacgaagaccatgctcactggacagaagcaaaaatgctgcttgacaacatcaacacaccagaagggattataccagctctctttgaaccagaaagggagaagtcagccgccatagacggtgaataccgcctgaagggtgagtccagaaagaccttcgtggaactcatgaggaggggtgaccttccagtttggctagcccacaaagtagcctcagaagggatcaaatacacagatagaaaatggtgctttgatggagaacgtaataatcaaattttagaggagaacatggacgtggaaatctggacaaaggaaggagaaaggaaaaaattgagacctaggtggcttgatgcccgcacttattcaaatcccttagcactcaaagaatttaaggattttgcagctggcagaaagtcaatcgctcttgatcttgtgacagaaataggaagagtgccttcacacctagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggactcatttgtgttattgtttccagtggcatgttatggatggccgatgtcccacttcaatggatcgcgtcagctatagtcctggaatttttcatgatggtgctgctcataccagaaccagagaagcagagaactccccaagacaaccaactcgcatatgtcgtgataggcatactcacactggctgcgatagtagcagccaatgaaatgggactactggagactacaaagagagatttaggaatgtctaaagaaccaggtgttgtttctccaaccagttatttagatgtagatttgcacccagcatcagcctggacattgtacgctgtggccacaacagtaataacaccaatgttgagacataccatagagaattccacagcaaatgtgtctctggcagccatagctaaccaggcagtggtcctgatgggtttggacaaaggatggccaatatcgaaaatggacctaggtgtaccactactggcactgggctgctattcacaagtgaacccactgactctcacagcggcagtacttctgctagttacacattatgccattataggtccaggattgcaggctaaagccactcgtgaggctcaaaaaaggacagctgcaggaataatgaagaatccaacggtggatgggataatgacaatagacctagatcctgtaatatacgattcaaaatttgaaaagcaactaggacaggttatgctcctggtcctgtgtgcagttcaacttttgttaatgagaacatcatgggccttgtgtgaagctctaaccttagccacaggaccaataacaacactttgggaaggatcacctggaaagttttggaacaccacaatagctgtctccatggctaacatctttagagggagctacttagcaggagctggacttgctttttctatcatgaaatcagttggaacaggaaagagaggaacggggtcacaaggcgaaaccttaggagaaaaatggaaaaagaaattaaatcagttatcccggagagagtttgaactttacaagaaatctggaatcactgaagtggatagaacagaagccaaagaggggctgaaaagaggagaaacaacacatcatgccgtgtccagaggcagtgcaaaacttcaatggttcgtggagaggaacatggtcattcctgaaggaagagtcatagacttaggctgtggaagaggaggctggtcatattactgcgcaggactgaaaaaagttacagaagtacgaggatacacaaaaggaggcccaggacacgaagaaccagtacctatgtctacatatggatggaacacagttaagttaatgagcggaaaggatgtgttttatcttccacctgagaagtgtgacaccctattgtgtgacattggagaatcttcaccaagcccaacagtggaagaaagcagaactataagagttttgaagatggttgaaccatggctaaaaaacaaccagttttgcattaaagtattaaacccttacatgccgactgtgattgaacacctagaaagactacaaagaaaacatggaggaatgcttgtgagaaacccactctcacgaaactccacgcacgagatgtattggatatccaatggtaccggcaacatcgtctcttcagtcaatatggtatccagattgctactgaacagattcacaatgacacacagaagacccaccatagagaaagacgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagacacaactccatttgggcagcaaagagtctttaaagagaaagtggacaccaggacacccaggcccatgccagggacaagaaaggttatggagatcacagcggaatggctttggagaaccctgggaaggaacaaaagacccagattgtgcacaagggaagagttcacaaaaaaggtcagaaccaacgcggctatgggagccgtcttcacagaggagaaccaatgggagagtgcgagagctgctgttgaggacgaggaattctggaaacttgtgggcagagaacgtgaactccacaaattgggcaagtgtggaagctgcgtttacaacatgatgggcaagagagagaagaaactcggagagtttggcaaagcaaaaggcagcagagctatatggtacatgtggttgggagccaggtaccttgagttcgaagcactcggatttttaaatgaagaccactggttctcgcgtgaaaactcttacagtggagtagaaggagaaggactgcacaagttgggatacatcttaagagatatttccaagatacctggaggagccatgtatgctgatgacacagctggttgggacacaagaataacagaagatgacctgcacaatgaggaaaaaatcacacagcaaatggaccctgaacatagacaattagcgaacgccatatttaagctcacgtaccaaaacaaagtggtcaaagttcaacgaccaaccccaaaaggcacggtaatggacatcatatctaggaaagaccaaagaggcagtggacaggtggggacttatggtctgaacacattcaccaacatggaagcccagttaatcagacagatggagggagaaggcgtgttgtcgaaggcagacctcgagaaccctcatctgctagagaagaaaatcacacaatggttggaaaccaaaggagtggagagattaaaaagaatggccatcagcggggatgattgtgtggtgaaaccgatcgatgacaggtttgctaatgccctgcttgccctgaacgatatgggaaaggttaggaaggacatacctcaatggcagccatcaaagggctggcatgactggcaacaggtccctttctgctcccatcattttcatgaactgatcatgaaagatggaagaaagttggtggttccctgcagaccccaggacgaactaataggaagagcgagaatctctcaaggagcagggtggagcctcaaagaaactgcatgtctagggaaagcctacgctcaaatgtggagtctcatgtattttcatagaagagatcttagactagcatccaacgccatttgctcagcagtaccagtccattgggtccccacaagcagaacgacatggtctattcacgcacaccaccagtggatgaccacagaagacatgcttactgtctggaacagggtgtggatagaggacaatccatggatggaagacaaaactccagtcacaacttgggaggatgttccatacctagggaagagagaagatcaatggtgcggatcacttatcggtctcacttccagagcaacctgggcccaaaacatactcacagcaatccaacaggtgagaagccttataggcgatgaagagtttctggactacatgccctcgatgaagagattcaggaaggaggaggagtcagagggagccatttggtaa

SEQ ID NO: 7705 - RNA, 9873 nt, synthetic construct
  misc_feature 1..9873: note = derived and/or modified CDS sequence (wt) from DENV-3__KJ622198__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacggcttctggaatcaacatgtgtacactcatagccatggacttaggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtagcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttatactactaatgctggtcactccatccatggctatgagatgcgtgggagtaggaaacagagattttgtggaaggtctgtcgggagctacatgggttgatgtggtgctcgagcacggtgggtgtgtgaccaccatggctaagaacaagcccacgctggacatagagcttcagaagaccgaggccactcaactggcgaccctaaggaaattatgcattgaggggaaaataaccaacataacaactgactcaaggtgtcctacccagggggaagcgattttacctgaggagcaggaccagaactacgtatgtaagcacacttacgtggatagaggttggggaaacggttgtggtttgtttggaaaaggaagtttggtgacatgcgcaaaatttcaatgtctagaatcaatagagggaaaagtggtgcaacatgagaacctcaaatacactgtcaccattacagtgcacacaggagaccaacaccaggtgggaaatgacacgcagggagtcacagctgagataacaccccaggcatcaaccgttgaagctatcctgcctgaatatggaacccttgggctagaatgttcaccacgcacaggtttggatttcaatgaaatgattctattgacaatgaagaataaagcatggatggtacatagacaatggttttttgacctacccctaccatggacatcaggagctataacagagacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatttttgcggggcacttgaaatgcagactcaagatggacaaattggaactcaaggggatgagctatgcaatgtgcttgaatacctttgtgttaaagaaagaagtctctgaaacgcagcatgggacaatactcattaaggttgaatacaaaggggaagatgcaccttgcaagattcccttctccacagaggatggacaagggaaagcccacaatggtagactgatcacagccaacccagtggtgaccaagaaggaggagcctgtcaacattgaggctgaacctccttttggggaaagtaacatagtgatcggaattggagacaaagccttgaaaatcaactggtacaagaagggaagctcgatcgggaagatgttcgaggccactgccagaggtgcaaggcgcatggccatcttgggagacacagcctgggactttggatcagtgggtggcgttctaaattcattagggaaaatggtgcaccaaatattcggaagtgcttacacagccctgtttggtggagtctcatggataatgaaaattggaataggtgttcttttaacctggatagggttgaattcaaaaaacacttccatgtcattttcatgcattgtgataggaataatcacactctatctgggaactgtggtacaagctgacatggggtgtgtcataaactggaaaggaaaagaactcaaatgtggaagtggaatctttgtcaccaatgaggtccacacctggacagagcaatacaaatttcaagcagactcccctaaaagactggcgacggccattgcaggcgcttgggaaaatggagtctgcggaatcaggtcgacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgacagctgaaatacaaaattcttctttcataatagatgggccaaacacaccggagtgtccaagtgcctcaagagcatggaatgtgtgggaggtggaagattacgggtttggagttttcacaaccaacatatggctgaaactccgagaggtgtacacccaaacatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgattatcccaaagagtctagccggtcccatttcgcaacacaaccacaggcccgggtaccacacccaaacggcaggaccctggcacttgggaaaattggaactggacttcaactattgtgaaggaacaacagtagtcatcacagaaaactgtgggacaagaggcccatcactgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtctggcaatcctcttcgaagaggtgatgagaggaaaatttgggaaaaagcacatgattgcaggggttctcctcacgtttatgctccttctctcagggcagataacatggagagatatggctcacacactcataatgattgggtccaacgcttctgacaggatgggaatgggtgttacctacctagctttaatagcaacattcaagattcagccattcttggctttgggattctttctaaggaaattgacatccagagaaaatttgctgttgggagttggattggccatggcaacaacgctacaactgccagaggacattgaacaaatggcgaatggaatcgctctggggctcatggctctaaaactgataacacaatttgagacataccagttatggacggcattagtctccctaacgtgttcaaacacaattttcacgttgactgttgcctggagaacagccaccttgattctggccggagtttcgctattgccagtgtgccagtcttcgagcatgaggaaaacagattggctcccagtggctgtggcagctatgggagttccacccttaccactttttatcttcagtttgaaagatacactcaaaaggaggagctggccactgaatgagggggtgatggctgttggccttgtgagcattctagctagttctctccttaggaatgacgtgcccatggctggaccactagtggctgggggcttgctgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaagatgatgagactgagaacatcctaacagtgctcttaaaaacggcattactaatagtatcaggcatctttccatactcaatacccgccacattgttggtctggcatacttggcaaaagcaaacccaaagatctggtgttctatgggatgtacccagccccccagaaacacagaaagcagaactggaagagggggtctacaggatcaaacaacaaggaatctttggaaaaacccaagtgggggttggagtacagaaagaaggagtcttccacaccatgtggcacgttacaagaggggcagtgttgacgcacaatgggaaaagactggaaccaaactgggccagcgtgaaaaaagacctgatttcatacggaggaggatggagattgagtgcacaatggcaaaagggagaggaagtgcaggttattgccgtagagcctgggaggaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtagttacaaaaaatggtggctacgtcagtggaatagcgcaagcaaacgcagaaccagacggaccgacaccggaattggaagaagaaatgtttaaaaagcgaaatctaaccataatggatcttcatcctgggtcaggaaagacgcggaaatatctcccagccattgtcagagaagcaatcaagagacgcttaagaactttaattttggcaccaacaagagtggttgcagctgagatggaagaagcattgaaaggactcccaataaggtatcaaacaactgcaacaaaatctgaacacacaggaagggagattgttgacctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaatcttcatgacagcaacaccccctggaacagccgaagcctttccccagagcaacgctccaattcaagatgaagaaagggacattccggaacgctcatggaattcaggcaatgaatggattaccgactttgttgggaagacggtgtggtttgtccctagcatcaaagccggaaatgacatagcaaactgcttgcggaaaaatgggaaaaaggtcattcaactcagtaggaagacttttgacacagaatatcaaaaaaccaaactgaatgattgggacttcgtggtgacaacagacatttcagaaatgggagccaactttaaagcagatagagtgatcgacccaagaagatgtctcaagccagtgattttgacagatggacctgagcgggtgattttggctggaccaatgccagtcactgcagcgagtgctgcgcaaaggagagggagagtcggcaggaatccacaaaaagaaaatgatcagtacatattcacgggtcagcctctcaacaatgacgaagaccatgctcactggacagaagcaaaaatgctgcttgacaacatcaacacaccagaagggattataccagctctctttgaaccagaaagggagaagtcagccgccatagacggtgaataccgcctgaagggtgagtccagaaagaccttcgtggaactcatgaggaggggtgaccttccagtttggctagcccacaaagtagcctcagaagggatcaaatacacagatagaaaatggtgctttgatggagaacgtaataatcaaattttagaggagaacatggacgtggaaatctggacaaaggaaggagaaaggaaaaaattgagacctaggtggcttgatgcccgcacttattcaaatcccttagcactcaaagaatttaaggattttgcagctggcagaaagtcaatcgctcttgatcttgtgacagaaataggaagagtgccttcacacctagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggactcatttgtgttattgtttccagtggcatgttatggatggccgatgtcccacttcaatggatcgcgtcagctatagtcctggaatttttcatgatggtgctgctcataccagaaccagagaagcagagaactccccaagacaaccaactcgcatatgtcgtgataggcatactcacactggctgcgatagtagcagccaatgaaatgggactactggagactacaaagagagatttaggaatgtctaaagaaccaggtgttgtttctccaaccagttatttagatgtagatttgcacccagcatcagcctggacattgtacgctgtggccacaacagtaataacaccaatgttgagacataccatagagaattccacagcaaatgtgtctctggcagccatagctaaccaggcagtggtcctgatgggtttggacaaaggatggccaatatcgaaaatggacctaggtgtaccactactggcactgggctgctattcacaagtgaacccactgactctcacagcggcagtacttctgctagttacacattatgccattataggtccaggattgcaggctaaagccactcgtgaggctcaaaaaaggacagctgcaggaataatgaagaatccaacggtggatgggataatgacaatagacctagatcctgtaatatacgattcaaaatttgaaaagcaactaggacaggttatgctcctggtcctgtgtgcagttcaacttttgttaatgagaacatcatgggccttgtgtgaagctctaaccttagccacaggaccaataacaacactttgggaaggatcacctggaaagttttggaacaccacaatagctgtctccatggctaacatctttagagggagctacttagcaggagctggacttgctttttctatcatgaaatcagttggaacaggaaagagaggaacggggtcacaaggcgaaaccttaggagaaaaatggaaaaagaaattaaatcagttatcccggagagagtttgaactttacaagaaatctggaatcactgaagtggatagaacagaagccaaagaggggctgaaaagaggagaaacaacacatcatgccgtgtccagaggcagtgcaaaacttcaatggttcgtggagaggaacatggtcattcctgaaggaagagtcatagacttaggctgtggaagaggaggctggtcatattactgcgcaggactgaaaaaagttacagaagtacgaggatacacaaaaggaggcccaggacacgaagaaccagtacctatgtctacatatggatggaacacagttaagttaatgagcggaaaggatgtgttttatcttccacctgagaagtgtgacaccctattgtgtgacattggagaatctttaccaagcccaacagtggaagaaagcagaactataagagttttgaagatggttgaaccatggctaaaaaacaaccagttttgcattaaagtattaaacccttacatgccgactgtgattgaacacctagaaagactacaaagaaaacatggaggaatgcttgtgagaaacccactctcacgaaactccacgcacgagatgtattggatatccaatggtaccggcaacatcgtctcttcagtcaatatggtatccagattgctactgaacagattcacaatgacacacagaagacccaccatagagaaagacgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagacacaactccatttgggcagcaaagagtctttaaagagaaagtggacaccaggacacccaggcccatgccagggacaagaaaggttatggagatcacagcggaatggctttggagaaccctgggaaggaacaaaagacccagattgtgcacaagggaagagttcacaaaaaaggtcagaaccaacgcggctatgggagccgtcttcacagaggagaaccaatgggagagtgcgagagctgctgttgaggacgaggaattctggaaacttgtgggcagagaacgtgaactccacaaattgggcaagtgtggaagctgcgtttacaacatgatgggcaagagagagaagaaactcggagagtttggcaaagcaaaaggcagcagagctatatggtacatgtggttgggagccaggtaccttgagttcgaagcactcggatttttaaatgaagaccactggttctcgcgtgaaaactcttacagtggagtagaaggagaaggactgcacaagttgggatacatcttaagagatatttccaagatacctggaggagccatgtatgctgatgacacagctggttgggacacaagaataacagaagatgacctgcacaatgaggaaaaaatcacacagcaaatggaccctgaacatagacaattagcgaacgccatatttaagctcacgtaccaaaacaaagtggtcaaagttcaacgaccaaccccaaaaggcacggtaatggacatcatatctaggaaagaccaaagaggcagtggacaggtggggacttatggtctgaacacattcaccaacatggaagcccagttaatcagacagatggagggagaaggcgtgttgtcgaaggcagacctcgagaaccctcatctgctagagaagaaaatcacacaatggttggaaaccaaaggagtggagagattaaaaagaatggccatcagcggggatgattgtgtggtgaaaccgatcgatgacaggtttgctaatgccctgcttgccctgaacgatatgggaaaggttaggaaggacatacctcaatggcagccatcaaagggctggcatgactggcaacaggtccctttctgctcccatcattttcatgaactgatcatgaaagatggaagaaagttggtggttccctgcagaccccaggacgaactaataggaagagcgagaatctctcaaggagcagggtggagcctcaaagaaactgcatgtctagggaaagcctacgctcaaatgtggagtctcatgtattttcatagaagagatcttagactagcatccaacgccatttgctcagcagtaccagtccattgggtccccacaagcagaacgacatggtctattcacgcacaccaccagtggatgaccacagaagacatgcttactgtctggaacagggtgtggatagaggacaatccatggatggaagacaaaactccagtcacaacttgggaggatgttccatacctagggaagagagaagatcaatggtgcggatcacttatcggtctcacttccagagcaacctgggcccaaaacatactcacagcaatccaacaggtgagaagccttataggcgatgaagagtttctggactacatgccctcgatgaagagattcaggaaggaggaggagtcagagggagccatttggtaa

SEQ ID NO: 7706 - RNA, 9873 nt, synthetic construct
  misc_feature 1..9873: note = derived and/or modified CDS sequence (wt) from DENV-3__KJ622191__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacggcttctggaatcaacatgtgtacactcatagccatggacttaggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtagcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttatactactaatgctggtcactccatccatggctatgagatgcgtgggagtaggaaacagagattttgtggaaggtctgtcgggagctacatgggttgatgtggtgctcgagcacggtgggtgtgtgaccaccatggctaagaacaagcccacgctggacatagagcttcagaagaccgaggccactcaactggcgaccctaaggaaattatgcattgaggggaaaataaccaacataacaactgactcaaggtgtcctacccagggggaagcgattttacctgaggagcaggaccagaactacgtatgtaagcacacttacgtggatagaggttggggaaacggttgtggtttgtttggaaaaggaagtttggtgacatgcgcaaaatttcaatgtctagaatcaatagagggaaaagtggtgcaacatgagaacctcaaatacaccgtcaccattacagtgcacacaggagaccaacaccaggtgggaaatgacacgcagggagtcacagctgagataacaccccaggcatcaaccgttgaagctatcctgcctgaatatggaacccttgggctagaatgttcaccacgcacaggtttggatttcaatgaagtgattctattgacaatgaagaataaagcatggatggtacatagacaatggttttttgacctacccctaccatggacatcaggagctataacagagacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatttttgcggggcacttgaaatgcagactcaagatggacaaattggaactcaaggggatgagctatgcaatgtgcttgaatacctttgtgttaaagaaagaagtctctgaaacgcagcatgggacaatactcattaaggttgaatacaaaggggaagatgcaccttgcaagattcccttctccacagaggatggacaagggaaagcccacaatggtagactgatcacagccaacccagtggtgaccaagaaggaggagcctgtcaacattgaggctgaacctccttttggggaaagcaacatagtgatcggaattggagacaaagccttgaaaatcaactggtacaagaagggaagctcgatcgggaagatgttcgaggccactgccagaggtgcaaggcgcatggccatcttgggagacacagcctgggactttggatcagtgggtggcgttctaaattcattagggaaaatggtgcaccaaatattcggaagtgcttacacagccctgtttggtggagtctcatggataatgaaaattggaataggtgttcttttaacctggatagggttgaattcaaaaaacacttccatgtcattttcatgcattgtgataggaataatcacactctatctgggaactgtggtacaagctgacatggggtgtgtcataaactggaaaggaaaagaactcaaatgtggaagtggaatctttgtcaccaatgaggtccacacctggacagagcaatacaaatttcaagcagactcccctaaaagactggcgacggccattgcaggcgcttgggaaaatggagtctgcggaatcaggtcgacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgacagctgaaatacaaaattcttctttcataatagatgggccaaacacaccggagtgtccaagtgcctcaagagcatggaatgtgtgggaggtggaagattacgggtttggagttttcacaaccaacatatggctgaaactccgagaggtgtacacccaaacatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgattatcccaaagagtctagccggtcccatttcgcaacacaaccacaggcccgggtaccacacccaaacggcaggaccctggcacttgggaaaattggaactggacttcaactattgtgaaggaacaacagtagtcatcacagaaaactgtgggacaagaggcccatcactgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtctggcaatcctcttcgaagaggtgatgagaggaaaatttgggaaaaagcacatgattgcaggggttctcctcacgtttatgctccttctctcagggcagataacatggagagatatggctcacacactcataatgattgggtccaacgcttctgacaggatgggaatgggtgttacctacctagctttaatagcaacattcaagattcagccattcttggctttgggattctttctaaggaaattgacatccagagaaaatttgctgttgggagttggattggccatggcaacaacgctacaactgccagaggacattgaacaaatggcgaatggaatcgctctggggctcatggctctaaaactgataacacaatttgagacataccagttatggacggcattagtctccctaacgtgttcaaacacaattttcacgttgactgttgcctggagaacagccaccttgattctggccggagtttcgctattgccagtgtgccagtcttcgagcatgaggaaaacagattggctcccagtggctgtggcagctatgggagttccacccttaccactttttatcttcagtttgaaagatacactcaaaaggaggagctggccactgaatgagggggtgatggctgttggccttgtgagcattctagctagttctctccttaggaatgacgtgcccatggctggaccactagtggctgggggcttgctgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaagatgatgagactgagaacatcctaacagtgctcttaaaaacggcattactaatagtatcaggcatctttccatactcaatacccgccacattgttggtctggcatacttggcaaaagcaaacccaaagatctggtgttctatgggatgtacccagccccccagaaacacagaaagcagaactggaagagggggtctacaggatcaaacaacaaggaatctttggaaaaacccaagtgggggttggagtacagaaagaaggagtcttccacaccatgtggcacgttacaagaggggcagtgttgacgcacaatgggaaaagactggaaccaaactgggccagcgtgaaaaaagacctgatttcatacggaggaggatggagattgagtgcgcaatggcaaaagggagaggaagtgcaggttattgccgtagagcctgggaggaacccaaaaaactttcaaaccatgccgggtatttttcagacaacaatgggggaaataggagcaattgcactagacttcaagcctggaacttcaggatctcctatcataaacagagagggaaaggtagtgggactgtatggcaatggagtagttacaaaaaatggtggctacgtcagtggaatagcgcaagcaaacgcagaaccagacggaccgacaccggaattggaagaagaaatgtttaaaaagcgaaatctaaccataatggatcttcatcctgggtcaggaaagacgcggaaatatctcccagccattgtcagagaagcaatcaagagacgcttaagaactttaattttggcaccaacaagagtggttgcagctgagatggaagaagcattgaaaggactcccaataaggtatcaaacaactgcaacaaaatctgaacacacaggaagggagattgttgacctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaatcttcatgacagcaacaccccctggaacagccgaagcctttccccagagcaacgctccaattcaagatgaagaaagggacattccggaacgctcatggaattcaggcaatgaatggattaccgactttgttgggaagacggtgtggtttgtccctagcatcaaagccggaaatgacatagcaaactgcttgcggaaaaatgggaaaaaggtcattcaactcagtaggaagacttttgacacagaatatcaaaaaaccaaactgaatgattgggacttcgtggtgacaacagacatttcagaaatgggagccaactttaaagcagatagagtgatcgacccaagaagatgtctcaagccagtgattttgacagatggacctgagcgggtgattttggctggaccaatgccagtcactgcagcgagtgctgcgcaaaggagagggagagtcggcaggaatccacaaaaagaaaatgatcagtacatattcacgggtcagcctctcaacaatgacgaagaccatgctcactggacagaagcaaaaatgctgcttgacaacatcaacacaccagaagggattataccagctctctttgaaccagaaagggagaagtcagccgccatagacggtgaataccgcctgaagggtgagtccagaaagaccttcgtggaactcatgaggaggggtgaccttccagtttggctagcccacaaagtagcctcagaagggatcaaatacacagatagaaaatggtgctttgatggagaacgtaataatcaaattttagaggagaacatggacgtggaaatctggacaaaggaaggagaaaggaaaaaattgagacctaggtggcttgatgcccgcacttattcagatcccttagcactcaaagaatttaaggattttgcagctggcagaaagtcaatcgctcttgatcttgtgacagaaataggaagagtgccttcacacctagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggactcatttgtgttattgtttccagtggcatgttatggatggccgatgtcccacttcaatggatcgcgtcagctatagtcctggaatttttcatgatggtgctgctcataccagaaccagagaagcagagaactccccaagacaaccaactcgcatatgtcgtgataggcatactcacactggctgcgatagtagcagccaatgaaatgggactactggagactacaaagagagatttaggaatgtctaaagaaccaggtgttgtttctccaaccagttatttagatgtagatttgcacccagcatcagcctggacattgtacgctgtggccacaacagtaataacaccaatgttgagacataccatagagaattccacagcaaatgtgtctctggcagccatagctaaccaggcagtggtcctgatgggtttggacaaaggatggccaatatcgaaaatggacctaggtgtaccactactggcactgggctgctattcacaagtgaacccactgactctcacagcggcagtacttctgctagttacacattatgccattataggtccaggattgcaggctaaagccactcgtgaggctcaaaaaaggacagctgcaggaataatgaagaatccaacggtggatgggataatgacaatagacctagatcctgtaatatacgattcaaaatttgaaaagcaactaggacaggttatgctcctggtcctgtgtgcagttcaacttttgttaatgagaacatcatgggccttgtgtgaagctctaaccttagccacaggaccaataacaacactttgggaaggatcacctggaaagttttggaacaccacaatagctgtctccatggctaacatctttagagggagctacttagcaggagctggacttgctttttctatcatgaaatcagttggaacaggaaagagaggaacggggtcacaaggcgaaaccttaggagaaaaatggaaaaagaaattaaatcagttatcccggagagagtttgaactttacaagaaatctggaatcactgaagtggatagaacagaagccaaagaggggctgaaaagaggagaaacaacacatcatgccgtgtccagaggcagtgcaaaacttcaatggttcgtggagaggaacatggtcattcctgaaggaagagtcatagacttaggctgtggaagaggaggctggtcatattactgcgcaggactgaaaaaagttacagaagtacgaggatacacaaaaggaggcccaggacacgaagaaccagtacctatgtctacatatggatggaacacagttaagttaatgagcggaaaggatgtgttttatcttccacctgagaagtgtgacaccctattgtgtgacattggagaatcttcaccaagcccaacagtggaagaaagcagaactataagagttttgaagatggttgaaccatggctaaaaaacaaccagttttgcattaaagtattaaacccttacatgccgactgtgattgaacacctagaaagactacaaagaaaacatggaggaatgcttgtgagaaacccactctcacgaaactccacgcacgagatgtattggatatccaatggtaccggcaacatcgtctcttcagtcaatatggtatccagattgctactgaacagattcacaatgacacacagaagacccaccatagagaaagacgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagacacaactccatttgggcagcaaagagtctttaaagagaaagtggacaccaggacacccaggcccatgccagggacaagaaaggttatggagatcacagcggaatggctttggagaaccctgggaaggaacaaaagacccagattgtgcacaagggaagagttcacaaaaaaggtcagaaccaacgcggctatgggagccgtcttcacagaggagaaccaatgggagagtgcgagagctgctgttgaggacgaggaattctggaaacttgtgggcagagaacgtgaactccacaaattgggcaagtgtggaagctgcgtttacaacatgatgggcaagagagagaagaaactcggagagtttggcaaagcaaaaggcagcagagctatatggtacatgtggttgggagccaggtaccttgagttcgaagcactcggatttttaaatgaagaccactggttctcgcgtgaaaactcttacagtggagtagaaggagaaggactgcacaagttgggatacatcttaagagatatttccaagatacctggaggagccatgtatgctgatgacacagctggttgggacacaagaataacagaagatgacctgcacaatgaggaaaaaatcacacagcaaatggaccctgaacatagacaattagcgaacgccatatttaagctcacgtaccaaaacaaagtggtcaaagttcaacgaccaaccccaaaaggcacggtaatggacatcatatctaggaaagaccaaagaggcagtggacaggtggggacttatggtctgaacacattcaccaacatggaagcccagttaatcagacagatggagggagaaggcgtgttgtcgaaggcagacctcgagaaccctcatctgctagagaagaaaatcacacaatggttggaaaccaaaggagtggagagattaaaaagaatggccatcagcggggatgattgtgtggtgaaaccgatcgatgacaggtttgctaatgccctgcttgccctgaacgatatgggaaaggttaggaaggacatacctcaatggcagccatcaaagggctggcatgactggcaacaggtccctttctgctcccatcattttcatgaactgatcatgaaagatggaagaaagttggtggttccctgcagaccccaggacgaactaataggaagagcgagaatctctcaaggagcagggtggagcctcaaagaaactgcatgtctagggaaagcctacgctcaaatgtggagtctcatgtattttcatagaagagatcttagactagcatccaacgccatttgctcagcagtaccagtccattgggtccccacaagcagaacgacatggtctattcacgcacaccaccagtggatgaccacagaagacatgcttactgtctggaacagggtgtggatagaggacaatccatggatggaagacaaaactccagtcacaacttgggaggatgttccatacctagggaagagagaagatcaatggtgcggatcacttatcggtctcacttccagagcaacctgggcccaaaacatactcacagcaatccaacaggtgagaagccttataggcgatgaagagtttctggactacatgccctcgatgaagagattcaggaaggaggaggagtcagagggagccatttggtaa

SEQ ID NO: 7707 - RNA, 9873 nt, synthetic construct
  misc_feature 1..9873: note = derived and/or modified CDS sequence (wt) from DENV-3__KJ622192__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacggcttctggaatcaacatgtgtacactcatagccatggacttaggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtagcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttatactactaatgctggtcactccatccatggctatgagatgcgtgggagtaggaaacagagattttgtggaaggtctgtcgggagctacatgggttgatgtggtgctcgagcacggtgggtgtgtgaccaccatggctaagaacaagcccacgctggacatagagcttcagaagaccgaggccactcaactggcgaccctaaggaaattatgcattgaggggaaaataaccaacataacaactgactcaaggtgtcctacccagggggaagcgattttacctgaggagcaggaccagaactacgtatgtaagcacacttacgtggatagaggttggggaaacggttgtggtttgtttggaaaaggaagtttggtgacatgcgcaaaatttcaatgtctagaatcaatagagggaaaagtggtgcaacatgagaacctcaaatacactgtcaccattacagtgcacacaggagaccaacaccaggtgggaaatgacacgcagggagtcacagctgagataacaccccaggcatcaaccgttgaagctatcctgcctgaatatggaacccttgggctagaatgttcaccacgcacaggtttggatttcaatgaaatgattctattgacaatgaagaataaagcatggatggtacatagacaatggttttttgacctacccctaccatggacatcaggagctataacagagacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatttttgcggggcacttgaaatgcagactcaagatggacaaattggaactcaaggggatgagctatgcaatgtgcttgaatacctttgtgttaaagaaagaagtctctgaaacgcagcatgggacaatactcattaaggttgaatacaaaggggaagatgcaccttgcaagattcccttctccacagaggatggacaagggaaagcccacaatggtagactgatcacagccaacccagtggtgaccaagaaggaggagcctgtcaacattgaggctgaacctccttttggggaaagtaacatagtgatcggaattggagacaaagccttgaaaatcaactggtacaagaagggaagctcgatcgggaagatgttcgaggccactgccagaggtgcaaggcgcatggccatcttgggagacacagcctgggactttggatcagtgggtggcgttctaaattcattagggaaaatggtgcaccaaatattcggaagtgcttacacagccctgtttggtggagtctcatggataatgaaaattggaataggtgttcttttaacctggatagggttgaattcaaaaaacacttccatgtcattttcatgcattgtgataggaataatcacactctatctgggaactgtggtacaagctgacatggggtgtgtcataaactggaaaggaaaagaactcaaatgtggaagtggaatctttgtcaccaatgaggtccacacctggacagagcaatacaaatttcaagcagactcccctaaaagactggcgacggccattgcaggcgcttgggaaaatggagtctgcggaatcaggtcgacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgacagctgaaatacaaaattcttctttcataatagatgggccaaacacaccggagtgtccaagtgcctcaagagcatggaatgtgtgggaggtggaagattacgggtttggagttttcacaaccaacatatggctgaaactccgagaggtgtacacccaaacatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgattatcccaaagagtctagccggtcccatttcgcaacacaaccacaggcccgggtaccacacccaaacggcaggaccctggcacttgggaaaattggaactggacttcaactattgtgaaggaacaacagtagtcatcacagaaaactgtgggacaagaggcccatcactgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtctggcaatcctcttcgaagaggtgatgagaggaaaatttgggaaaaagcacatgattgcaggggttctcctcacgtttatgctccttctctcagggcagataacatggagagatatggctcacacactcataatgattgggtccaacgcttctgacaggatgggaatgggtgttacctacctagctttaatagcaacattcaagattcagccattcttggctttgggattctttctaaggaaattgacatccagagaaaatttgctgttgggagttggattggccatggcaacaacgctacaactgccagaggacattgaacaaatggcgaatggaatcgctctggggctcatggctctaaaactgataacacaatttgagacataccagttatggacggcattagtctccctaacgtgttcaaacacaattttcacgttgactgttgcctggagaacagccaccttgattctggccggagtttcgctattgccagtgtgccagtcttcgagcatgaggaaaacagattggctcccagtggctgtggcagctatgggagttccacccttaccactttttatcttcagtttgaaagatacactcaaaaggaggagctggccactgaatgagggggtgatggctgttggccttgtgagcattctagctagttctctccttaggaatgacgtgcccatggctggaccactagtggctgggggcttgctgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaagatgatgagactgagaacatcctaacagtgctcttaaaaacggcattactaatagtatcaggcatctttccatactcaatacccgccacattgttggtctggcatacttggcaaaagcaaacccaaagatctggtgttctatgggatgtacccagccccccagaaacacagaaagcagaactggaagagggggtctacaggatcaaacaacaaggaatctttggaaaaacccaagtgggggttggagtacagaaagaaggagtcttccacaccatgtggcacgttacaagaggggcagtgttgacgcacaatgggaaaagactggaaccaaactgggccagcgtgaaaaaagacctgatttcatacggaggaggatggagattgagtgcacaatggcaaaagggagaggaagtgcaggttattgccgtagagcctgggaggaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtagttacaaaaaatggtggctacgtcagtggaatagcgcaagcaaacgcagaaccagacggaccgacaccggaattggaagaagaaatgtttaaaaagcgaaatctaaccataatggatcttcatcctgggtcaggaaagacgcggaaatatctcccagccattgtcagagaagcaatcaagagacgcttaagaactttaattttggcaccaacaagagtggttgcagctgagatggaagaagcattgaaaggactcccaataaggtatcaaacaactgcaacaaaatctgaacacacaggaagggagattgttgacctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaatcttcatgacagcaacaccccctggaacagccgaagcctttccccagagcaacgctccaattcaagatgaagaaagggacattccggaacgctcatggaattcaggcaatgaatggattaccgactttgttgggaagacggtgtggtttgtccctagcatcaaagccggaaatgacatagcaaactgcttgcggaaaaatgggaaaaaggtcattcaactcagtaggaagacttttgacacagaatatcaaaaaaccaaactgaatgattgggacttcgtggtgacaacagacatttcagaaatgggagccaactttaaagcagatagagtgatcgacccaagaagatgtctcaagccagtgattttgacagatggacctgagcgggtgattttggctggaccaatgccagtcactgcagcgagtgctgcgcaaaggagagggagagtcggcaggaatccacaaaaagaaaatgatcagtacatattcacgggtcagcctctcaacaatgacgaagaccatgctcactggacagaagcaaaaatgctgcttgacaacatcaacacaccagaagggattataccagctctctttgaaccagaaagggagaagtcagccgccatagacggtgaataccgcctgaagggtgagtccagaaagaccttcgtggaactcatgaggaggggtgaccttccagtttggctagcccacaaagtagcctcagaagggatcaaatacacagatagaaaatggtgctttgatggagaacgtaataatcaaattttagaggagaacatggacgtggaaatctggacaaaggaaggagaaaggaaaaaattgagacctaggtggcttgatgcccgcacttattcagatcccttagcactcaaagaatttaaggattttgcagctggcagaaagtcaatcgctcttgatcttgtgacagaaataggaagagtgccttcacacctagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggactcatttgtgttattgtttccagtggcatgttatggatggccgatgtcccacttcaatggatcgcgtcagctatagtcctggaatttttcatgatggtgctgctcataccagaaccagagaagcagagaactccccaagacaaccaactcgcatatgtcgtgataggcatactcacactggctgcgatagtagcagccaatgaaatgggactactggagactacaaagagagatttaggaatgtctaaagaaccaggtgttgtttctccaaccagttatttagatgtagatttgcacccagcatcagcctggacattgtacgctgtggccacaacagtaataacaccaatgttgagacataccatagagaattccacagcaaatgtgtctctggcagccatagctaaccaggcagtggtcctgatgggtttggacaaaggatggccaatatcgaaaatggacctaggtgtaccactactggcactgggctgctattcacaagtgaacccactgactctcacagcggcagtacttctgctagttacacattatgccattataggtccaggattgcaggctaaagccactcgtgaggctcaaaaaaggacagctgcaggaataatgaagaatccaacggtggatgggataatgacaatagacctagatcctgtaatatacgattcaaaatttgaaaagcaactaggacaggttatgctcctggtcctgtgtgcagttcaacttttgttaatgagaacatcatgggccttgtgtgaagctctaaccttagccacaggaccaataacaacactttgggaaggatcacctggaaagttttggaacaccacaatagctgtctccatggctaacatctttagagggagctacttagcaggagctggacttgctttttctatcatgaaatcagttggaacaggaaagagaggaacggggtcacaaggcgaaaccttaggagaaaaatggaaaaagaaattaaatcagttatcccggagagagtttgaactttacaagaaatctggaatcactgaagtggatagaacagaagccaaagaggggctgaaaagaggagaaacaacacatcatgccgtgtccagaggcagtgcaaaacttcaatggttcgtggagaggaacatggtcattcctgaaggaagagtcatagacttaggctgtggaagaggaggctggtcatattactgcgcaggactgaaaaaagttacagaagtacgaggatacacaaaaggaggcccaggacacgaagaaccagtacctatgtctacatatggatggaacacagttaagttaatgagcggaaaggatgtgttttatcttccacctgagaagtgtgacaccctattgtgtgacattggagaatcttcaccaagcccaacagtggaagaaagcagaactataagagttttgaagatggttgaaccatggctaaaaaacaaccagttttgcattaaagtattaaacccttacatgccgactgtgattgaacacctagaaagactacaaagaaaacatggaggaatgcttgtgagaaacccactctcacgaaactccacgcacgagatgtattggatatccaatggtaccggcaacatcgtctcttcagtcaatatggtatccagattgctactgaacagattcacaatgacacacagaagacccaccatagagaaagacgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagacacaactccatttgggcagcaaagagtctttaaagagaaagtggacaccaggacacccaggcccatgccagggacaagaaaggttatggagatcacagcggaatggctttggagaaccctgggaaggaacaaaagacccagattgtgcacaagggaagagttcacaaaaaaggtcagaaccaacgcggctatgggagccgtcttcacagaggagaaccaatgggagagtgcgagagctgctgttgaggacgaggaattctggaaacttgtgggcagagaacgtgaactccacaaattgggcaagtgtggaagctgcgtttacaacatgatgggcaagagagagaagaaactcggagagtttggcaaagcaaaaggcagcagagctatatggtacatgtggttgggagccaggtaccttgagttcgaagcactcggatttttaaatgaagaccactggttctcgcgtgaaaactcttacagtggagtagaaggagaaggactgcacaagttgggatacatcttaagagatatttccaagatacctggaggagccatgtatgctgatgacacagctggttgggacacaagaataacagaagatgacctgcacaatgaggaaaaaatcacacagcaaatggaccctgaacatagacaattagcgaacgccatatttaagctcacgtaccaaaacaaagtggtcaaagttcaacgaccaaccccaaaaggcacggtaatggacatcatatctaggaaagaccaaagaggcagtggacaggtggggacttatggtctgaacacattcaccaacatggaagcccagttaatcagacagatggagggagaaggcgtgttgtcgaaggcagacctcgagaaccctcatctgctagagaagaaaatcacacaatggttggaaaccaaaggagtggagagattaaaaagaatggccatcagcggggatgattgtgtggtgaaaccgatcgatgacaggtttgctaatgccctgcttgccctgaacgatatgggaaaggttaggaaggacatacctcaatggcagccatcaaagggctggcatgactggcaacaggtccctttctgctcccatcattttcatgaactgatcatgaaagatggaagaaagttggtggttccctgcagaccccaggacgaactaataggaagagcgagaatctctcaaggagcagggtggagcctcaaagaaactgcatgtctagggaaagcctacgctcaaatgtggagtctcatgtattttcatagaagagatcttagactagcatccaacgccatttgctcagcagtaccagtccattgggtccccacaagcagaacgacatggtctattcacgcacaccaccagtggatgaccacagaagacatgcttactgtctggaacagggtgtggatagaggacaatccatggatggaagacaaaactccagtcacaacttgggaggatgttccatacctagggaagagagaagatcaatggtgcggatcacttatcggtctcacttccagagcaacctgggcccaaaacatactcacagcaatccaacaggtgagaagccttataggcgatgaagagtttctggactacatgccctcgatgaagagattcaggaaggaggaggagtcagagggagccatttggtaa

SEQ ID NO: 7708 - RNA, 9873 nt, synthetic construct
  misc_feature 1..9873: note = derived and/or modified CDS sequence (wt) from DENV-3__KJ622193__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacggcttctggaatcaacatgtgtacactcatagccatggacttaggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtagcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttatactactaatgctggtcactccatccatggctatgagatgcgtgggagtaggaaacagagattttgtggaaggtctgtcgggagctacatgggttgatgtggtgctcgagcacggtgggtgtgtgaccaccatggctaagaacaagcccacgctggacatagagcttcagaagaccgaggccactcaactggcgaccctaaggaaattatgcattgaggggaaaataaccaacataacaactgactcaaggtgtcctacccagggggaagcgattttacctgaggagcaggaccagaactacgtatgtaagcacacttacgtggatagaggttggggaaacggttgtggtttgtttggaaaaggaagtttggtgacatgcgcaaaatttcaatgtctagaatcaatagagggaaaagtggtgcaacatgagaacctcaaatacactgtcaccattacagtgcacacaggagaccaacaccaggtgggaaatgacacgcagggagtcacagctgagataacaccccaggcatcaaccgttgaagctatcctgcctgaatatggaacccttgggctagaatgttcaccacgcacaggtttggatttcaatgaaatgattctattgacaatgaagaataaagcatggatggtacatagacaatggttttttgacctacccctaccatggacatcaggagctataacagagacaccaacttggaacaggaaagagcttcttgtgacattcaaaaatgcacatgcaaaaaagcaaggagtagtcgtccttggatcgcaagagggagcaatgcacacagcgctgacaggagctacagagattcaaaactcaggaggtacaagcatttttgcggggcacttgaaatgcagactcaagatggacaaattggaactcaaggggatgagctatgcaatgtgcttgaatacctttgtgttaaagaaagaagtctctgaaacgcagcatgggacaatactcattaaggttgaatacaaaggggaagatgcaccttgcaagattcccttctccacagaggatggacaagggaaagcccacaatggtagactgatcacagccaacccagtggtgaccaagaaggaggagcctgtcaacattgaggctgaacctccttttggggaaagtaacatagtgatcggaattggagacaaagccttgaaaatcaactggtacaagaagggaagctcgatcgggaagatgttcgaggccactgccagaggtgcaaggcgcatggccatcttgggagacacagcctgggactttggatcagtgggtggcgttctaaattcattagggaaaatggtgcaccaaatattcggaagtgcttacacagccctgtttggtggagtctcatggataatgaaaattggaataggtgttcttttaacctggatagggttgaattcaaaaaacacttccatgtcattttcatgcattgtgataggaataatcacactctatctgggaactgtggtacaagctgacatggggtgtgtcataaactggaaaggaaaagaactcaaatgtggaagtggaatctttgtcaccaatgaggtccacacctggacagagcaatacaaatttcaagcagactcccctaaaagactggcgacggccattgcaggcgcttgggaaaatggagtctgcggaatcaggtcgacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgacagctgaaatacaaaattcttctttcataatagatgggccaaacacaccggagtgtccaagtgcctcaagagcatggaatgtgtgggaggtggaagattacgggtttggagttttcacaaccaacatatggctgaaactccgagaggtgtacacccaaacatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgattatcccaaagagtctagccggtcccatttcgcaacacaaccacaggcccgggtaccacacccaaacggcaggaccctggcacttgggaaaattggaactggacttcaactattgtgaaggaacaacagtagtcatcacagaaaactgtgggacaagaggcccatcactgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtctggcaatcctcttcgaagaggtgatgagaggaaaatttgggaaaaagcacatgattgcaggggttctcctcacgtttatgctccttctctcagggcagataacatggagagatatggctcacacactcataatgattgggtccaacgcttctgacaggatgggaatgggtgttacctacctagctttaatagcaacattcaagattcagccattcttggctttgggattctttctaaggaaattgacatccagagaaaatttgctgttgggagttggattggccatggcaacaacgctacaactgccagaggacattgaacaaatggcgaatggaatcgctctggggctcatggctctaaaactgataacacaatttgagacataccagttatggacggcattagtctccctaacgtgttcaaacacaattttcacgttgactgttgcctggagaacagccaccttgattctggccggagtttcgctattgccagtgtgccagtcttcgagcatgaggaaaacagattggctcccagtggctgtggcagctatgggagttccacccttaccactttttatcttcagtttgaaagatacactcaaaaggaggagctggccactgaatgagggggtgatggctgttggccttgtgagcattctagctagttctctccttaggaatgacgtgcccatggctggaccactagtggctgggggcttgctgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaagatgatgagactgagaacatcctaacagtgctcttaaaaacggcattactaatagtatcaggcatctttccatactcaatacccgccacattgttggtctggcatacttggcaaaagcaaacccaaagatctggtgttctatgggatgtacccagccccccagaaacacagaaagcagaactggaagagggggtctacaggatcaaacaacaaggaatctttggaaaaacccaagtgggggttggagtacagaaagaaggagtcttccacaccatgtggcacgttacaagaggggcagtgttgacgcacaatgggaaaagactggaaccaaactgggccagcgtgaaaaaagacctgatttcatacggaggaggatggagattgagtgcacaatggcaaaagggagaggaagtgcaggttattgccgtagagcctgggaggaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtagttacaaaaaatggtggctacgtcagtggaatagcgcaagcaaacgcagaaccagacggaccgacaccggaattggaagaagaaatgtttaaaaagcgaaatctaaccataatggatcttcatcctgggtcaggaaagacgcggaaatatctcccagccattgtcagagaagcaatcaagagacgcttaagaactttaattttggcaccaacaagagtggttgcagctgagatggaagaagcattgaaaggactcccaataaggtatcaaacaactgcaacaaaatctgaacacacaggaagggagattgttgacctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaatcttcatgacagcaacaccccctggaacagccgaagcctttccccagagcaacgctccaattcaagatgaagaaagggacattccggaacgctcatggaattcaggcaatgaatggattaccgactttgttgggaagacggtgtggtttgtccctagcatcaaagccggaaatgacatagcaaactgcttgcggaaaaatgggaaaaaggtcattcaactcagtaggaagacttttgacacagaatatcaaaaaaccaaactgaatgattgggacttcgtggtgacaacagacatttcagaaatgggagccaactttaaagcagatagagtgatcgacccaagaagatgtctcaagccagtgattttgacagatggacctgagcgggtgattttggctggaccaatgccagtcactgcagcgagtgctgcgcaaaggagagggagagtcggcaggaatccacaaaaagaaaatgatcagtacatattcacgggtcagcctctcaacaatgacgaagaccatgctcactggacagaagcaaaaatgctgcttgacaacatcaacacaccagaagggattataccagctctctttgaaccagaaagggagaagtcagccgccatagacggtgaataccgcctgaagggtgagtccagaaagaccttcgtggaactcatgaggaggggtgaccttccagtttggctagcccacaaagtagcctcagaagggatcaaatacacagatagaaaatggtgctttgatggagaacgtaataatcaaattttagaggagaacatggacgtggaaatctggacaaaggaaggagaaaggaaaaaattgagacctaggtggcttgatgcccgcacttattcagatcccttagcactcaaagaatttaaggattttgcagctggcagaaagtcaatcgctcttgatcttgtgacagaaataggaagagtgccttcacacctagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggactcatttgtgttattgtttccagtggcatgttatggatggccgatgtcccacttcaatggatcgcgtcagctatagtcctggaatttttcatgatggtgctgctcataccagaaccagagaagcagagaactccccaagacaaccaactcgcatatgtcgtgataggcatactcacactggctgcgatagtagcagccaatgaaatgggactactggagactacaaagagagatttaggaatgtctaaagaaccaggtgttgtttctccaaccagttatttagatgtagatttgcacccagcatcagcctggacattgtacgctgtggccacaacagtaataacaccaatgttgagacataccatagagaattccacagcaaatgtgtctctggcagccatagctaaccaggcagtggtcctgatgggtttggacaaaggatggccaatatcgaaaatggacctaggtgtaccactactggcactgggctgctattcacaagtgaacccactgactctcacagcggcagtacttctgctagttacacattatgccattataggtccaggattgcaggctaaagccactcgtgaggctcaaaaaaggacagctgcaggaataatgaagaatccaacggtggatgggataatgacaatagacctagatcctgtaatatacgattcaaaatttgaaaagcaactaggacaggttatgctcctggtcctgtgtgcagttcaacttttgttaatgagaacatcatgggccttgtgtgaagctctaaccttagccacaggaccaataacaacactttgggaaggatcacctggaaagttttggaacaccacaatagctgtctccatggctaacatctttagagggagctacttagcaggagctggacttgctttttctatcatgaaatcagttggaacaggaaagagaggaacggggtcacaaggcgaaaccttaggagaaaaatggaaaaagaaattaaatcagttatcccggagagagtttgaactttacaagaaatctggaatcactgaagtggatagaacagaagccaaagaggggctgaaaagaggagaaacaacacatcatgccgtgtccagaggcagtgcaaaacttcaatggttcgtggagaggaacatggtcattcctgaaggaagagtcatagacttaggctgtggaagaggaggctggtcatattactgcgcaggactgaaaaaagttacagaagtacgaggatacacaaaaggaggcccaggacacgaagaaccagtacctatgtctacatatggatggaacacagttaagttaatgagcggaaaggatgtgttttatcttccacctgagaagtgtgacaccctattgtgtgacattggagaatcttcaccaagcccaacagtggaagaaagcagaactataagagttttgaagatggttgaaccatggctaaaaaacaaccagttttgcattaaagtattaaacccttacatgccgactgtgattgaacacctagaaagactacaaagaaaacatggaggaatgcttgtgagaaacccactctcacgaaactccacgcacgagatgtattggatatccaatggtaccggcaacatcgtctcttcagtcaatatggtatccagattgctactgaacagattcacaatgacacacagaagacccaccatagagaaagacgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagacacaactccatttgggcagcaaagagtctttaaagagaaagtggacaccaggacacccaggcccatgccagggacaagaaaggttatggagatcacagcggaatggctttggagaaccctgggaaggaacaaaagacccagattgtgcacaagggaagagttcacaaaaaaggtcagaaccaacgcggctatgggagccgtcttcacagaggagaaccaatgggagagtgcgagagctgctgttgaggacgaggaattctggaaacttgtgggcagagaacgtgaactccacaaattgggcaagtgtggaagctgcgtttacaacatgatgggcaagagagagaagaaactcggagagtttggcaaagcaaaaggcagcagagctatatggtacatgtggttgggagccaggtaccttgagttcgaagcactcggatttttaaatgaagaccactggttctcgcgtgaaaactcttacagtggagtagaaggagaaggactgcacaagttgggatacatcttaagagatatttccaagatacctggaggagccatgtatgctgatgacacagctggttgggacacaagaataacagaagatgacctgcacaatgaggaaaaaatcacacagcaaatggaccctgaacatagacaattagcgaacgccatatttaagctcacgtaccaaaacaaagtggtcaaagttcaacgaccaaccccaaaaggcacggtaatggacatcatatctaggaaagaccaaagaggcagtggacaggtggggacttatggtctgaacacattcaccaacatggaagcccagttaatcagacagatggagggagaaggcgtgttgtcgaaggcagacctcgagaaccctcatctgctagagaagaaaatcacacaatggttggaaaccaaaggagtggagaggttaaaaagaatggccatcagcggggatgattgtgtggtgaaaccgatcgatgacaggtttgctaatgccctgcttgccctgaacgatatgggaaaggttaggaaggacatacctcaatggcagccatcaaagggctggcatgactggcaacaggtccctttctgctcccatcattttcatgaactgatcatgaaagatggaagaaagttggtggttccctgcagaccccaggacgaactaataggaagagcgagaatctctcaaggagcagggtggagcctcaaagaaactgcatgtctagggaaagcctacgctcaaatgtggagtctcatgtattttcatagaagagatcttagactagcatccaacgccatttgctcagcagtaccagtccattgggtccccacaagcagaacgacatggtctattcacgcacaccaccagtggatgaccacagaagacatgcttactgtctggaacagggtgtggatagaggacaatccatggatggaagacaaaactccagtcacaacttgggaggatgttccatacctagggaagagagaagatcaatggtgcggatcacttatcggtctcacttccagagcaacctgggcccaaaacatactcacagcaatccaacaggtgagaagccttataggcgatgaagagtttctggactacatgccctcgatgaagagattcaggaaggaggaggagtcagagggagccatttggtaa

SEQ ID NO: 7709 - RNA, 9873 nt, synthetic construct
  misc_feature 1..9873: note = derived and/or modified CDS sequence (wt) from DENV-3__KJ622194__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacggcttctggaatcaacatgtgtacactcatagccatggacttaggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtagcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttatactactaatgctggtcactccatccatggctatgagatgcgtgggagtaggaaacagagattttgtggaaggtctgtcgggagctacatgggttgatgtggtgctcgagcacggtgggtgtgtgaccaccatggctaagaacaagcccacgctggacatagagcttcagaagaccgaggccactcaactggcgaccctaaggaaattatgcattgaggggaaaataaccaacataacaactgactcaaggtgtcctacccagggggaagcgattttacctgaggagcaggaccagaactacgtatgtaagcacacttacgtggatagaggttggggaaacggttgtggtttgtttggaaaaggaagtttggtgacatgcgcaaaatttcaatgtctagaatcaatagagggaaaagtggtgcaacatgagaacctcaaatacactgtcaccattacagtgcacacaggagaccaacaccaggtgggaaatgacacgcagggagtcacagctgagataacaccccaggcatcaaccgttgaagctatcctgcctgaatatggaacccttgggctagaatgttcaccacgcacaggtttggatttcaatgaaatgattctattgacaatgaagaataaagcatggatggtacatagacaatggttttttgacctacccctaccatggacatcaggagctataacagagacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatttttgcggggcacttgaaatgcagactcaagatggacaaattggaactcaaggggatgagctatgcaatgtgcttgaatacctttgtgttaaagaaagaagtctctgaaacgcagcatgggacaatactcattaaggttgaatacaaaggggaagatgcaccttgcaagattcccttctccacagaggatggacaagggaaagcccacaatggtagactgatcacagccaacccagtggtgaccaagaaggaggagcctgtcaacattgaggctgaacctccttttggggaaagtaacatagtgatcggaattggagacaaagccttgaaaatcaactggtacaagaagggaagctcgatcgggaagatgttcgaggccactgccagaggtgcaaggcgcatggccatcttgggagacacagcctgggactttggatcagtgggtggcgttctaaattcattagggaaaatggtgcaccaaatattcggaagtgcttacacagccctgtttggtggagtctcatggataatgaaaattggaataggtgttcttttaacctggatagggttgaattcaaaaaacacttccatgtcattttcatgcattgtgataggaataatcacactctatctgggaactgtggtacaagctgacatggggtgtgtcataaactggaaaggaaaagaactcaaatgtggaagtggaatctttgtcaccaatgaggtccacacctggacagagcaatacaaatttcaagcagactcccctaaaagactggcgacggccattgcaggcgcttgggaaaatggagtctgcggaatcaggtcgacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgacagctgaaatacaaaattcttctttcataatagatgggccaaacacaccggagtgtccaagtgcctcaagagcatggaatgtgtgggaggtggaagattacgggtttggagttttcacaaccaacatatggctgaaactccgagaggtgtacacccaaacatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgattatcccaaagagtctagccggtcccatttcgcaacacaaccacaggcccgggtaccacacccaaacggcaggaccctggcacttgggaaaattggaactggacttcaactattgtgaaggaacaacagtagtcatcacagaaaactgtgggacaagaggcccatcactgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtctggcaatcctcttcgaagaggtgatgagaggaaaatttgggaaaaagcacatgattgcaggggttctcctcacgtttatgctccttctctcagggcagataacatggagagatatggctcacacactcataatgattgggtccaacgcttctgacaggatgggaatgggtgttacctacctagctttaatagcaacattcaagattcagccattcttggctttgggattctttctaaggaaattgacatccagagaaaatttgctgttgggagttggattggccatggcaacaacgctacaactgccagaggacattgaacaaatggcgaatggaatcgctctggggctcatggctctaaaactgataacacaatttgagacataccagttatggacggcattagtctccctaacgtgttcaaacacaattttcacgttgactgttgcctggagaacagccaccttgattctggccggagtttcgctattgccagtgtgccagtcttcgagcatgaggaaaacagattggctcccagtggctgtggcagctatgggagttccacccttaccactttttatcttcagtttgaaagatacactcaaaaggaggagctggccactgaatgagggggtgatggctgttggccttgtgagcattctagctagttctctccttaggaatgacgtgcccatggctggaccactagtggctgggggcttgctgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaagatgatgagactgagaacatcctaacagtgctcttaaaaacggcattactaatagtatcaggcatctttccatactcaatacccgccacattgttggtctggcatacttggcaaaagcaaacccaaagatctggtgttctatgggatgtacccagccccccagaaacacagaaagcagaactggaagagggggtctacaggatcaaacaacaaggaatctttggaaaaacccaagtgggggttggagtacagaaagaaggagtcttccacaccatgtggcacgttacaagaggggcagtgttgacgcacagtgggaaaagactggaaccaaactgggccagcgtgaaaaaagacctgatttcatacggaggaggatggagattgagtgcacaatggcaaaagggagaggaagtgcaggttattgccgtagagcctgggaggaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtagttacaaaaaatggtggctacgtcagtggaatagcgcaagcaaacgcagaaccagacggaccgacaccggaattggaagaagaaatgtttaaaaagcgaaatctaaccataatggatcttcatcctgggtcaggaaagacgcggaaatatctcccagccattgtcagagaagcaatcaagagacgcttaagaactttaattttggcaccaacaagagtggttgcagctgagatggaagaagcattgaaaggactcccaataaggtatcaaacaactgcaacaaaatctgaacacacaggaagggagattgttgacctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaatcttcatgacagcaacaccccctggaacagccgaagcctttccccagagcaacgctccaattcaagatgaagaaagggacattccggaacgctcatggaattcaggcaatgaatggattaccgactttgttgggaagacggtgtggtttgtccctagcatcaaagccggaaatgacatagcaaactgcttgcggaaaaatgggaaaaaggtcattcaactcagtaggaagacttttgacacagaatatcaaaaaaccaaactgaatgattgggacttcgtggtgacaacagacatttcagaaatgggagccaactttaaagcagatagagtgatcgacccaagaagatgtctcaagccagtgattttgacagatggacctgagcgggtgattttggctggaccaatgccagtcactgcagcgagtgctgcgcaaaggagagggagagtcggcaggaatccacaaaaagaaaatgatcagtacatattcacgggtcagcctctcaacaatgacgaagaccatgctcactggacagaagcaaaaatgctgcttgacaacatcaacacaccagaagggattataccagctctctttgaaccagaaagggagaagtcagccgccatagacggtgaataccgcctgaagggtgagtccagaaagaccttcgtggaactcatgaggaggggtgaccttccagtttggctagcccacaaagtagcctcagaagggatcaaatacacagatagaaaatggtgctttgatggagaacgtaataatcaaattttagaggagaacatggacgtggaaatctggacaaaggaaggagaaaggaaaaaattgagacctaggtggcttgatgcccgcacttattcagatcccttagcactcaaagaatttaaggattttgcagctggcagaaagtcaatcgctcttgatcttgtgacagaaataggaagagtgccttcacacctagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggactcatttgtgttattgtttccagtggcatgttatggatggccgatgtcccacttcaatggatcgcgtcagctatagtcctggaatttttcatgatggtgctgctcataccagaaccagagaagcagagaactccccaagacaaccaactcgcatatgtcgtgataggcatactcacactggctgcgatagtagcagccaatgaaatgggactactggagactacaaagagagatttaggaatgtctaaagaaccaggtgttgtttctccaaccagttatttagatgtagatttgcacccagcatcagcctggacattgtacgctgtggccacaacagtaataacaccaatgttgagacataccatagagaattccacagcaaatgtgtctctggcagccatagctaaccaggcagtggtcctgatgggtttggacaaaggatggccaatatcgaaaatggacctaggtgtaccactactggcactgggctgctattcacaagtgaacccactgactctcacagcggcagtacttctgctagttacacattatgccattataggtccaggattgcaggctaaagccactcgtgaggctcaaaaaaggacagctgcaggaataatgaagaatccaacggtggatgggataatgacaatagacctagatcctgtaatatacgattcaaaatttgaaaagcaactaggacaggttatgctcctggtcctgtgtgcagttcaacttttgttaatgagaacatcatgggccttgtgtgaagctctaaccttagccacaggaccaataacaacactttgggaaggatcacctggaaagttttggaacgccacaatagctgtctccatggctaacatctttagagggagctacttagcaggagctggacttgctttttctatcatgaaatcagttggaacaggaaagagaggaacggggtcacaaggcgaaaccttaggagaaaaatggaaaaagaaattaaatcagttatcccggagagagtttgaactttacaagaaatctggaatcactgaagtggatagaacagaagccaaagaggggctgaaaagaggagaaacaacacatcatgccgtgtccagaggcagtgcaaaacttcaatggttcgtggagaggaacatggtcattcctgaaggaagagtcatagacttaggctgtggaagaggaggctggtcatattactgcgcaggactgaaaaaagttacagaagtacgaggatacacaaaaggaggcccaggacacgaagaaccagtacctatgtctacatatggatggaacacagttaagttaatgagcggaaaggatgtgttttatcttccacctgagaagtgtgacaccctattgtgtgacattggagaatcttcaccaagcccaacagtggaagaaagcagaactataagagttttgaagatggttgaaccatggctaaaaaacaaccagttttgcattaaagtattaaacccttacatgccgactgtgattgaacacctagaaagactacaaagaaaacatggaggaatgcttgtgagaaacccactctcacgaaactccacgcacgagatgtattggatatccaatggtaccggcaacatcgtctcttcagtcaatatggtatccagattgctactgaacagattcacaatgacacacagaagacccaccatagagaaagacgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagacacaactccatttgggcagcaaagagtctttaaagagaaagtggacaccaggacacccaggcccatgccagggacaagaaaggttatggagatcacagcggaatggctttggagaaccctgggaaggaacaaaagacccagattgtgcacaagggaagagttcacaaaaaaggtcagaaccaacgcggctatgggagccgtcttcacagaggagaaccaatgggagagtgcgagagctgctgttgaggacgaggaattctggaaacttgtgggcagagaacgtgaactccacaaattgggcaagtgtggaagctgcgtttacaacatgatgggcaagagagagaagaaactcggagagtttggcaaagcaaaaggcagcagagctatatggtacatgtggttgggagccaggtaccttgagttcgaagcactcggatttttaaatgaagaccactggttctcgcgtgaaaactcttacagtggagtagaaggagaaggactgcacaagttgggatacatcttaagagatatttccaagatacctggaggagccatgtatgctgatgacacagctggttgggacacaagaataacagaagatgacctgcacaatgaggaaaaaatcacacagcaaatggaccctgaacatagacaattagcgaacgccatatttaagctcacgtaccaaaacaaagtggtcaaagttcaacgaccaaccccaaaaggcacggtaatggacatcatatctaggaaagaccaaagaggcagtggacaggtggggacttatggtctgaacacattcaccaacatggaagcccagttaatcagacagatggagggagaaggcgtgttgtcgaaggcagacctcgagaaccctcatctgctagagaagaaaatcacacaatggttggaaaccaaaggagtggagagattaaaaagaatggccatcagcggggatgattgtgtggtgaaaccgatcgatgacaggtttgctaatgccctgcttgccctgaacgatatgggaaaggttaggaaggacatacctcaatggcagccatcaaagggctggcatgactggcaacaggtccctttctgctcccatcattttcatgaactgatcatgaaagatggaagaaagttggtggttccctgcagaccccaggacgaactaataggaagagcgagaatctctcaaggagcagggtggagcctcaaagaaactgcatgtctagggaaagcctacgctcaaatgtggagtctcatgtattttcatagaagagatcttagactagcatccaacgccatttgctcagcagtaccagtccattgggtccccacaagcagaacgacatggtctattcacgcacaccaccagtggatgaccacagaagacatgcttactgtctggaacagggtgtggatagaggacaatccatggatggaagacaaaactccagtcacaacttgggaggatgttccatacctagggaagagagaagatcaatggtgcggatcacttatcggtctcacttccagagcaacctgggcccaaaacatactcacagcaatccaacaggtgagaagccttataggcgatgaagagtttctggactacatgccctcgatgaagagattcaggaaggaggaggagtcagagggagccatttggtaa

SEQ ID NO: 7710 - RNA, 9873 nt, synthetic construct
  misc_feature 1..9873: note = derived and/or modified CDS sequence (wt) from DENV-3__KJ622195__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacggcttctggaatcaacatgtgtacactcatagccatggacttaggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtagcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttatactactaatgctggtcactccatccatggctatgagatgcgtgggagtaggaaacagagattttgtggaaggtctgtcgggagctacatgggttgatgtggtgctcgagcacggtgggtgtgtgaccaccatggctaagaacaagcccacgctggacatagagcttcagaagaccgaggccactcaactggcgaccctaaggaaattatgcattgaggggaaaataaccaacataacaactgactcaaggtgtcctacccagggggaagcgattttacctgaggagcaggaccagaactacgtatgtaagcacacttacgtggatagaggttggggaaacggttgtggtttgtttggaaaaggaagtttggtgacatgcgcaaaatttcaatgtctagaatcaatagagggaaaagtggtgcaacatgagaacctcaaatacactgtcaccattacagtgcacacaggagaccaacaccaggtgggaaatgacacgcagggagtcacagctgagataacaccccaggcatcaaccgttgaagctatcctgcctgaatatggaacccttgggctagaatgttcaccacgcacaggtttggatttcaatgaaatgattctattgacaatgaagaataaagcatggatggtacatagacaatggttttttgacctacccctaccatggacatcaggagctataacagagacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatttttgcggggcacttgaaatgcagactcaagatggacaaattggaactcaaggggatgagctatgcaatgtgcttgaatacctttgtgttaaagaaagaagtctctgaaacgcagcatgggacaatactcattaaggttgaatacaaaggggaagatgcaccttgcaagattcccttctccacagaggatggacaagggaaagcccacaatggtagactgatcacagccaacccagtggtgaccaagaaggaggagcctgtcaacattgaggctgaacctccttttggggaaagtaacatagtgatcggaattggagacaaagccttgaaaatcaactggtacaagaagggaagctcgatcgggaagatgttcgaggccactgccagaggtgcaaggcgcatggccatcttgggagacacagcctgggactttggatcagtgggtggcgttctaaattcattagggaaaatggtgcaccaaatattcggaagtgcttacacagccctgtttggtggagtctcatggataatgaaaattggaataggtgttcttttaacctggatagggttgaattcaaaaaacacttccatgtcattttcatgcattgtgataggaataatcacactctatctgggaactgtggtacaagctgacatggggtgtgtcataaactggaaaggaaaagaactcaaatgtggaagtggaatctttgtcaccaatgaggtccacacctggacagagcaatacaaatttcaagcagactcccctaaaagactggcgacggccattgcaggcgcttgggaaaatggagtctgcggaatcaggtcgacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgacagctgaaatacaaaattcttctttcataatagatgggccaaacacaccggagtgtccaagtgcctcaagagcatggaatgtgtgggaggtggaagattacgggtttggagttttcacaaccaacatatggctgaaactccgagaggtgtacacccaaacatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgattatcccaaagagtctagccggtcccatttcgcaacacaaccacaggcccgggtaccacacccaaacggcaggaccctggcacttgggaaaattggaactggacttcaactattgtgaaggaacaacagtagtcatcacagaaaactgtgggacaagaggcccatcactgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtctggcaatcctcttcgaagaggtgatgagaggaaaatttgggaaaaagcacatgattgcaggggttctcctcacgtttatgctccttctctcagggcagataacatggagagatatggctcacacactcataatgattgggtccaacgcttctgacaggatgggaatgggtgttacctacctagctttaatagcaacattcaagattcagccattcttggctttgggattctttctaaggaaattgacatccagagaaaatttgctgttgggagttggattggccatggcaacaacgctacaactgccagaggacattgaacaaatggcgaatggaatcgctctggggctcatggctctaaaactgataacacaatttgagacataccagttatggacggcattagtctccctaacgtgttcaaacacaattttcacgttgactgttgcctggagaacagccaccttgattctggccggagtttcgctattgccagtgtgccagtcttcgagcatgaggaaaacagattggctcccagtggctgtggcagctatgggagttccacccttaccactttttatcttcagtttgaaagatacactcaaaaggaggagctggccactgaatgagggggtgatggctgttggccttgtgagcattctagctagttctctccttaggaatgacgtgcccatggctggaccactagtggctgggggcttgctgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaagatgatgagactgagaacatcctaacagtgctcttaaaaacggcattactaatagtatcaggcatctttccatactcaatacccgccacattgttggtctggcatacttggcaaaagcaaacccaaagatctggtgttctatgggatgtacccagccccccagaaacacagaaagcagaactggaagagggggtctacaggatcaaacaacaaggaatctttggaaaaacccaagtgggggttggagtacagaaagaaggagtcttccacaccatgtggcacgttacaagaggggcagtgttgacgcacaatgggaaaagactggaaccaaactgggccagcgtgaaaaaagacctgatttcatacggaggaggatggagattgagtgcacaatggcaaaagggagaggaagtgcaggttattgccgtagagcctgggaggaacccaaaaaactttcaaaccatgccgggtatttttcagacaacaacgggggaaataggagcaattgcactagacttcaagcctggaacttcaggatctcctatcatagacagagagggaaaagtagtgggactgtatggcaatggagtagttacaaaaaatggtggctacgtcagtggaatagcgcaagcaaacgcagaaccagacggaccgacaccggaattggaagaagaaatgtttaaaaagcgaaatctaaccataatggatcttcatcctgggtcaggaaagacgcggaaatatctcccagccattgtcagagaagcaatcaagagacgcttaagaactttaattttggcaccaacaagagtggttgcagctgagatggaagaagcattgaaaggactcccaataaggtatcaaacaactgcaacaaaatctgaacacacaggaagggagattgttgacctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaatcttcatgacagcaacaccccctggaacagccgaagcctttccccagagcaacgctccaattcaagatgaagaaagggacattccggaacgctcatggaattcaggcaatgaatggattaccgactttgttgggaagacggtgtggtttgtccctagcatcaaagccggaaatgacatagcaaactgcttgcggaaaaatgggaaaaaggtcattcaactcagtaggaagacttttgacacagaatatcaaaaaaccaaactgaatgattgggacttcgtggtgacaacagacatttcagaaatgggagccaactttaaagcagatagagtgatcgacccaagaagatgtctcaagccagtgattttgacagatggacctgagcgggtgattttggctggaccaatgccagtcactgcagcgagtgctgcgcaaaggagagggagagtcggcaggaatccacaaaaagaaaatgatcagtacatattcacgggtcagcctctcaacaatgacgaagaccatgctcactggacagaagcaaaaatgctgcttgacaacatcaacacaccagaagggattataccagctctctttgaaccagaaagggagaagtcagccgccatagacggtgaataccgcctgaagggtgagtccagaaagaccttcgtggaactcatgaggaggggtgaccttccagtttggctagcccacaaagtagcctcagaagggatcaaatacacagatagaaaatggtgctttgatggagaacgtaataatcaaattttagaggagaacatggacgtggaaatctggacaaaggaaggagaaaggaaaaaattgagacctaggtggcttgatgcccgcacttattcaaatcccttagcactcaaagaatttaaggattttgcagctggcagaaagtcaatcgctcttgatcttgtgacagaaataggaagagtgccttcacacctagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggactcatttgtgttattgtttccagtggcatgttatggatggccgatgtcccacttcaatggatcgcgtcagctatagtcctggaatttttcatgatggtgctgctcataccagaaccagagaagcagagaactccccaagacaaccaactcgcatatgtcgtgataggcatactcacactggctgcgatagtagcagccaatgaaatgggactactggagactacaaagagagatttaggaatgtctaaagaaccaggtgttgtttctccaaccagttatttagatgtagatttgcacccagcatcagcctggacattgtacgctgtggccacaacagtaataacaccaatgttgagacataccatagagaattccacagcaaatgtgtctctggcagccatagctaaccaggcagtggtcctgatgggtttggacaaaggatggccaatatcgaaaatggacctaggtgtaccactactggcactgggctgctattcacaagtgaacccactgactctcacagcggcagtacttctgctagttacacattatgccattataggtccaggattgcaggctaaagccactcgtgaggctcaaaaaaggacagctgcaggaataatgaagaatccaacggtggatgggataatgacaatagacctagatcctgtaatatacgattcaaaatttgaaaagcaactaggacaggttatgctcctggtcctgtgtgcagttcaacttttgttaatgagaacatcatgggccttgtgtgaagctctaaccttagccacaggaccaataacaacactttgggaaggatcacctggaaagttttggaacaccacaatagctgtctccatggctaacatctttagagggagctacttagcaggagctggacttgctttttctatcatgaaatcagttggaacaggaaagagaggaacggggtcacaaggcgaaaccttaggagaaaaatggaaaaagaaattaaatcagttatcccggagagagtttgaactttacaagaaatctggaatcactgaagtggatagaacagaagccaaagaggggctgaaaagaggagaaacaacacatcatgccgtgtccagaggcagtgcaaaacttcaatggttcgtggagaggaacatggtcattcctgaaggaagagtcatagacttaggctgtggaagaggaggctggtcatattactgcgcaggactgaaaaaagttacagaagtacgaggatacacaaaaggaggcccaggacacgaagaaccagtacctatgtctacatatggatggaacacagttaagttaatgagcggaaaggatgtgttttatcttccacctgagaagtgtgacaccctattgtgtgacattggagaatcttcaccaagcccaacagtggaagaaagcagaactataagagttttgaagatggttgaaccatggctaaaaaacaaccagttttgcattaaagtattaaacccttacatgccgactgtgattgaacacctagaaagactacaaagaaaacatggaggaatgcttgtgagaaacccactctcacgaaactccacgcacgagatgtattggatatccaatggtaccggcaacatcgtctcttcagtcaatatggtatccagattgctactgaacagattcacaatgacacacagaagacccaccatagagaaagacgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagacacaactccatttgggcagcaaagagtctttaaagagaaagtggacaccaggacacccaggcccatgccagggacaagaaaggttatggagatcacagcggaatggctttggagaaccctgggaaggaacaaaagacccagattgtgcacaagggaagagttcacaaaaaaggtcagaaccaacgcggctatgggagccgtcttcacagaggagaaccaatgggagagtgcgagagctgctgttgaggacgaggaattctggaaacttgtgggcagagaacgtgaactccacaaattgggcaagtgtggaagctgcgtttacaacatgatgggcaagagagagaagaaactcggagagtttggcaaagcaaaaggcagcagagctatatggtacatgtggttgggagccaggtaccttgagttcgaagcactcggatttttaaatgaagaccactggttctcgcgtgaaaactcttacagtggagtagaaggagaaggactgcacaagttgggatacatcttaagagatatttccaagatacctggaggagccatgtatgctgatgacacagctggttgggacacaagaataacagaagatgacctgcacaatgaggaaaaaatcacacagcaaatggaccctgaacatagacaattagcgaacgccatatttaagctcacgtaccaaaacaaagtggtcaaagttcaacgaccaaccccaaaaggcacggtaatggacatcatatctaggaaagaccaaagaggcagtggacaggtggggacttatggtctgaacacattcaccaacatggaagcccagttaatcagacagatggagggagaaggcgtgttgtcgaaggcagacctcgagaaccctcatctgctagagaagaaaatcacacaatggttggaaaccaaaggagtggagagattaaaaagaatggccatcagcggggatgattgtgtggtgaaaccgatcgatgacaggtttgctaatgccctgcttgccctgaacgatatgggaaaggttaggaaggacatacctcaatggcagccatcaaagggctggcatgactggcaacaggtccctttctgctcccatcattttcatgaactgatcatgaaagatggaagaaagttggtggttccctgcagaccccaggacgaactaataggaagagcgagaatctctcaaggagcagggtggagcctcaaagaaactgcatgtctagggaaagcctacgctcaaatgtggagtctcatgtattttcatagaagagatcttagactagcatccaacgccatttgctcagcagtaccagtccattgggtccccacaagcagaacgacatggtctattcacgcacaccaccagtggatgaccacagaagacatgcttactgtctggaacagggtgtggatagaggacaatccatggatggaagacaaaactccagtcacaacttgggaggatgttccatacctagggaagagagaagatcaatggtgcggatcacttatcggtctcacttccagagcaacctgggcccaaaacatactcacagcaatccaacaggtgagaagccttataggcgatgaagagtttctggactacatgccctcgatgaagagattcaggaaggaggaggagtcagagggagccatttggtaa

SEQ ID NO: 7711 - RNA, 9873 nt, synthetic construct
  misc_feature 1..9873: note = derived and/or modified CDS sequence (wt) from DENV-3__KJ622196__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacggcttctggaatcaacatgtgtacactcatagccatggacttaggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtagcgttagctccccatgtcggcatgggactggacacacgcacccagacctggatgtcggctgaaggagcttggagacaagtcgagaaggtagagacatgggctcttaggcacccagggttcaccatactagctctatttctagcccattacataggcacttccctgacccagaaagtggttatttttatactactaatgctggtcactccatccatggctatgagatgcgtgggagtaggaaacagagattttgtggaaggtctgtcgggagctacatgggttgatgtggtgctcgagcacggtgggtgtgtgaccaccatggctaagaacaagcccacgctggacatagagcttcagaagaccgaggccactcaactggcgaccctaaggaaattatgcattgaggggaaaataaccaacataacaactgactcaaggtgtcctacccagggggaagcgattttacctgaggagcaggaccagaactacgtatgtaagcacacttacgtggatagaggttggggaaacggttgtggtttgtttggaaaaggaagtttggtgacatgcgcaaaatttcaatgtctagaatcaatagagggaaaagtggtgcaacatgagaacctcaaatacactgtcaccattacagtgcacacaggagaccaacaccaggtgggaaatgacacgcagggagtcacagctgagataacaccccaggcatcaaccgttgaagctatcctgcctgaatatggaacccttgggctagaatgttcaccacgcacaggtttggatttcaatgaaatgattctattgacaatgaagaataaagcatggatggtacatagacaatggttttttgacctacccctaccatggacatcaggagctataacagagacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggtacaagcatttttgcggggcacttgaaatgcagactcaagatggacaaattggaactcaaggggatgagctatgcaatgtgcttgaatacctttgtgttaaagaaagaagtctctgaaacgcagcatgggacaatactcattaaggttgaatacaaaggggaagatgcaccttgcaagattcccttctccacagaggatggacaagggaaagcccacaatggtagactgatcacagccaacccagtggtgaccaagaaggaggagcctgtcaacattgaggctgaacctccttttggggaaagtaacatagtgatcggaattggagacaaagccttgaaaatcaactggtacaagaagggaagctcgatcgggaagatgttcgaggccactgccagaggtgcaaggcgcatggccatcttgggagacacagcctgggactttggatcagtgggtggcgttctaaattcattagggaaaatggtgcaccaaatattcggaagtgcttacacagccctgtttggtggagtctcatggataatgaaaattggaataggtgttcttttaacctggatagggttgaattcaaaaaacacttccatgtcattttcatgcattgtgataggaataatcacactctatctgggaactgtggtacaagctgacatggggtgtgtcataaactggaaaggaaaagaactcaaatgtggaagtggaatctttgtcaccaatgaggtccacacctggacagagcaatacaaatttcaagcagactcccctaaaagactggcgacggccattgcaggcgcttgggaaaatggagtctgcggaatcaggtcgacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgacagctgaaatacaaaattcttctttcataatagatgggccaaacacaccggagtgtccaagtgcctcaagagcatggaatgtgtgggaggtggaagattacgggtttggagttttcacaaccaacatatggctgaaactccgagaggtgtacacccaaacatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgattatcccaaagagtctagccggtcccatttcgcaacacaaccacaggcccgggtaccacacccaaacggcaggaccctggcacttgggaaaattggaactggacttcaactattgtgaaggaacaacagtagtcatcacagaaaactgtgggacaagaggcccatcactgagaacaacaacagtgtcagggaagttgatacacgaatggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtctggcaatcctcttcgaagaggtgatgagaggaaaatttgggaaaaagcacatgattgcaggggttctcctcacgtttatgctccttctctcagggcagataacatggagagatatggctcacacactcataatgattgggtccaacgcttctgacaggatgggaatgggtgttacctacctagctttaatagcaacattcaagattcagccattcttggctttgggattctttctaaggaaattgacatccagagaaaatttgctgttgggagttggattggccatggcaacaacgctacaactgccagaggacattgaacaaatggcgaatggaatcgctctggggctcatggctctaaaactgataacacaatttgagacataccagttatggacggcattagtctccctaacgtgttcaaacacaattttcacgttgactgttgcctggagaacagccaccttgattctggccggagtttcgctattgccagtgtgccagtcttcgagcatgaggaaaacagattggctcccagtggctgtggcagctatgggagttccacccttaccactttttatcttcagtttgaaagatacactcaaaaggaggagctggccactgaatgagggggtgatggctgttggccttgtgagcattctagctagttctctccttaggaatgacgtgcccatggctggaccactagtggctgggggcttgctgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaagatgatgagactgagaacatcctaacagtgctcttaaaaacggcattactaatagtatcaggcatctttccatactcaatacccgccacattgttggtctggcatacttggcaaaagcaaacccaaagatctggtgttctatgggatgtacccagccccccagaaacacagaaagcagaactggaagagggggtctacaggatcaaacaacaaggaatctttggaaaaacccaagtgggggttggagtacagaaagaaggagtcttccacaccatgtggcacgttacaagaggggcagtgttgacgcacaatgggaaaagactggaaccaaactgggccagcgtgaaaaaagacctgatttcatacggaggaggatggagattgagtgcacaatggcaaaagggagaggaagtgcaggttattgccgtagagcctgggaggaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtagttacaaaaaatggtggctacgtcagtggaatagcgcaagcaaacgcagaaccagacggaccgacaccggaattggaagaagaaatgtttaaaaagcgaaatctaaccataatggatcttcatcctgggtcaggaaagacgcggaaatatctcccagccattgtcagagaagcaatcaagagacgcttaagaactttaattttggcaccaacaagagtggttgcagctgagatggaagaagcattgaaaggactcccaataaggtatcaaacaactgcaacaaaatctgaacacacaggaagggagattgttgacctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaatcttcatgacagcaacaccccctggaacagccgaagcctttccccagagcaacgctccaattcaagatgaagaaagggacattccggaacgctcatggaattcaggcaatgaatggattaccgactttgttgggaagacggtgtggtttgtccctagcatcaaagccggaaatgacatagcaaactgcttgcggaaaaatgggaaaaaggtcattcaactcagtaggaagacttttgacacagaatatcaaaaaaccaaactgaatgattgggacttcgtggtgacaacagacatttcagaaatgggagccaactttaaagcagatagagtgatcgacccaagaagatgtctcaagccagtgattttgacagatggacctgagcgggtgattttggctggaccaatgccagtcactgcagcgagtgctgcgcaaaggagagggagagtcggcaggaatccacaaaaagaaaatgatcagtacatattcacgggtcagcctctcaacaatgacgaagaccatgctcactggacagaagcaaaaatgctgcttgacaacatcaacacaccagaagggattataccagctctctttgaaccagaaagggagaagtcagccgccatagacggtgaataccgcctgaagggtgagtccagaaagaccttcgtggaactcatgaggaggggtgaccttccagtttggctagcccacaaagtagcctcagaagggatcaaatacacagatagaaaatggtgctttgatggagaacgtaataatcaaattttagaggagaacatggacgtggaaatctggacaaaggaaggagaaaggaaaaaattgagacctaggtggcttgatgcccgcacttattcaaatcccttagcactcaaagaatttaaggattttgcagctggcagaaagtcaatcgctcttgatcttgtgacagaaataggaagagtgccttcacacctagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggactcatttgtgttattgtttccagtggcatgttatggatggccgatgtcccacttcaatggatcgcgtcagctatagtcctggaatttttcatgatggtgctgctcataccagaaccagagaagcagagaaccccccaagacaaccaactcgcatatgtcgtgataggcatactcacactggctgcgatagtagcagccaatgaaatgggactactggagactacaaagagagatttaggaatgtctaaagaaccaggtgttgtttctccaaccagttatttagatgtagatttgcacccagcatcagcctggacattgtacgctgtggccacaacagtaataacaccaatgttgagacataccatagagaattccacagcaaatgtgtctctggcagccatagctaaccaggcagtggtcctgatgggtttggacaaaggatggccaatatcgaaaatggacctaggtgtaccactactggcactgggctgctattcacaagtgaacccactgactctcacagcggcagtacttctgctagttacacattatgccattataggtccaggattgcaggctaaagccactcgtgaggctcaaaaaaggacagctgcaggaataatgaagaatccaacggtggatgggataatgacaatagacctagatcctgtaatatacgattcaaaatttgaaaagcaactaggacaggttatgctcctggtcctgtgtgcagttcaacttttgttaatgagaacatcatgggccttgtgtgaagctctaaccttagccacaggaccaataacaacactttgggaaggatcacctggaaagttttggaacaccacaatagctgtctccatggctaacatctttagagggagctacttagcaggagctggacttgctttttctatcatgaaatcagttggaacaggaaagagaggaacggggtcacaaggcgaaaccttaggagaaaaatggaaaaagaaattaaatcagttatcccggagagagtttgaactttacaagaaatctggaatcactgaagtggatagaacagaagccaaagaggggctgaaaagaggagaaacaacacatcatgccgtgtccagaggcagtgcaaaacttcaatggttcgtggagaggaacatggtcattcctgaaggaagagtcatagacttaggctgtggaagaggaggctggtcatattactgcgcaggactgaaaaaagttacagaagtacgaggatacacaaaaggaggcccaggacacgaagaaccagtacctatgtctacatatggatggaacacagttaagttaatgagcggaaaggatgtgttttatcttccacctgagaagtgtgacaccctattgtgtgacattggagaatcttcaccaagcccaacagtggaagaaagcagaactataagagttttgaagatggttgaaccatggctaaaaaacaaccagttttgcattaaagtattaaacccttacatgccgactgtgattgaacacctagaaagactacaaagaaaacatggaggaatgcttgtgagaaacccactctcacgaaactccacgcacgagatgtattggatatccaatggtaccggcaacatcgtctcttcagtcaatatggtatccagattgctactgaacagattcacaatgacacacagaagacccaccatagagaaagacgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacatatggcaatgacagacacaactccatttgggcagcaaagagtctttaaagagaaagtggacaccaggacacccaggcccatgccagggacaagaaaggttatggagatcacagcggaatggctttggagaaccctgggaaggaacaaaagacccagattgtgcacaagggaagagttcacaaaaaaggtcagaaccaacgcggctatgggagccgtcttcacagaggagaaccaatgggagagtgcgagagctgctgttgaggacgaggaattctggaaacttgtgggcagagaacgtgaactccacaaattgggcaagtgtggaagctgcgtttacaacatgatgggcaagagagagaagaaactcggagagtttggcaaagcaaaaggcagcagagctatatggtacatgtggttgggagccaggtaccttgagttcgaagcactcggatttttaaatgaagaccactggttctcgcgtgaaaactcttacagtggagtagaaggagaaggactgcacaagttgggatacatcttaagagatatttccaagatacctggaggagccatgtatgctgatgacacagctggttgggacacaagaataacagaagatgacctgcacaatgaggaaaaaatcacacagcaaatggaccctgaacatagacaattagcgaacgccatatttaagctcacgtaccaaaacaaagtggtcaaagttcaacgaccaaccccaaaaggcacggtaatggacatcatatctaggaaagaccaaagaggcagtggacaggtggggacttatggtctgaacacattcaccaacatggaagcccagttaatcagacagatggagggagaaggcgtgttgtcgaaggcagacctcgagaaccctcatctgctagagaagaaaatcacacaatggttggaaaccaaaggagtggagagattaaaaagaatggccatcagcggggatgattgtgtggtgaaaccgatcgatgacaggtttgctaatgccctgcttgccctgaacgatatgggaaaggttaggaaggacatacctcaatggcagccatcaaagggctggcatgactggcaacaggtccctttctgctcccatcattttcatgaactgatcatgaaagatggaagaaagttggtggttccctgcagaccccaggacgaactaataggaagagcgagaatctctcaaggagcagggtggagcctcaaagaaactgcatgtctagggaaagcctacgctcaaatgtggagtctcatgtattttcatagaagagatcttagactagcatccaacgccatttgctcagcagtaccagtccattgggtccccacaagcagaacgacatggtctattcacgcacaccaccagtggatgaccacagaagacatgcttactgtctggaacagggtgtggatagaggacaatccatggatggaagacaaaactccagtcacaacttgggaggatgttccatacctagggaagagagaagatcaatggtgcggatcacttatcggtctcacttccagagcaacctgggcccaaaacatactcacagcaatccaacaggtgagaagccttataggcgatgaagagtttctggactacatgccctcgatgaagagattcaggaaggaggaggagtcagagggagccatttggtaa

SEQ ID NO: 7712 - RNA, 9873 nt, synthetic construct
  misc_feature 1..9873: note = derived and/or modified CDS sequence (wt) from DENV-3__KJ830751__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgtacactcatagccatggatttgggagagatgtgtgatgacacggtcacttataaatgcccccacattaccgaagtggaacctgaagacattgactgctggtgcaacctcacatcaacatgggtgacttatggaacgtgcaatcaagctggagagcacagacgcgacaagagatcagtggcgttagctcctcatgtcggcatgggattggacacacgcacccaaacctggatgtcggctgaaggagcttggagacaagtcgaaaaggtagagacatgggcccttaggcacccagggtttaccatactagccctatttctcgcccattacataggcacttccttgacccagaaggtggttattttcatattattaatgttggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgccctacccaaggggaagcggttttgcctgaggagcaggaccagaactacgtgtgtaagcatacatacgtggacagaggctgggggaacggttgtggtttgtttggcaaaggaagcttggtaacatgtgcgaaatttcaatgcctagaaccaatagagggaaaagtggtgcaatatgagaacctcaaatacaccgttatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggatttcaatgaaatgattttactaacaatgaagaacaaagcatggatggtacacagacaatggttcttcgacctacctctaccatgggcatcaggagcaacaacagaaacaccaacctggaacaggaaggagcttcttgtgacattcaaaaacgcacatgcgaaaaaacaagaagtagttgttcttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttaaaaaaagaagtctcagaaacgcagcacgggacaatactcattaaggttgagtacaagggggaagatgcaccttgcaagattcccttttccacagaggatggacaagggaaagctcacaatggcagactgatcacagccaaccctgtggtgactaagaaggaggagcccgtcaatattgaggctgaacctccttttggggaaagcaatatagtaattggaattggagacaacgccttgaaaatcaactggtacaagaaggggagctcgattgggaagatgttcgaggccactgccaggggtgcaaggcgcatggccatcttgggagacacagcttgggactttggatcagtgggtggcgttctgaattcattaggcaaaatggtgcaccaaatatttggaagtgcttacacagccctgttcagtggagtctcttgggtgatgaaaattggaataggtgtcctcttgacttggatagggttgaattcaaaaaacacatccatgtcattttcatgcattgcgataggaatcattacactctatctgggagctgtggtacaagctgacatggggtgtgtcataaactggaaaggcaaagaactcaaatgcggaagcggaattttcgtcaccaatgaggtccacacctggacagagcaatacaaattccaagcagactccccaaaaagattggcaacagccattgcaggcgcttgggagaatggagtgtgtggaattaggtcaacaaccagaatggagaacctcttgtggaagcaaatagccaatgaactgaactacatattatgggaaaacaatatcaaattaacagtagttgtgggcgatacaattggggtcttagagcaagggaagagaacactaacaccacaacccatggagctaaaatactcatggaaaacgtggggaaaggcgaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctactggatagaaagccaaaagaatggaagttggaagctagaaaaagcatccctcatagaggtaaaaacctgcacatggccaaaatcacacactctctggagtaatggtgtgctagagagtgacatgatcatcccaaagagtctagctggtcctatctcacaacacaactacaggcccgggtaccacacccaaacggcaggaccctggcacttaggaaaattggagctggacttcaactactgtgaaggaacaacagttgtcatcacagaaagctgtggaacaagaggcccatcattgagaacaacaacagtgtcagggaagttgatacacgaatggtgttgccgctcgtgcacacttccccccctgcgatacatgggagaagacggctgctggtatggcatggaaatcagacccatcagcgagaaagaagagaacatggtaaagtctttagtctctgcaggaagtggaaaggtggacaacttcacaatgggtgtcttgtgtttggcaatcctctatgaagaggtgatgagaggaaaatttgggaagaaacacatgattgcaggggttttctttacgtttgtgctccttctctcagggcaaataacgtggagaaacatggcgcacacactaataatgattgggtccaacgcctctgacaggatgggaatgggcgtcacctacctagctctaattgcaacatttaaaatccaaccattcttggctttgggatttttcctaagaaagctgacatctagagaaaatttattgctaggagttgggttggccatggcaacaacgttacaactgccagatgacattgaacaaatggcaaatggaattgctctggggctcatggctcttaaactgataacacaatttgaaacataccaattgtggacggcattagtctccttaacgtgttcaaacacaatgtttacgttgactgttgcctggaggacagccactctgattttggccggagtttcgcttttaccagtgtgccagtcttcaagcatgaggaaaacagattggctcccaatggcagtggcagccatgggagttccaccccttccactttttatttttaacttgaaagacacactcaaaaggagaagttggccgctgaatgagggggtgatggctgttgggcttgtgagcattctggccagttccctccttagaaatgatgtgcccatggctgggccattagtggccgggggcttgctgatagcgtgctacgtcataactggcacgtcagcagacctcactgtagaaaaagcagcagatgtgacatgggaggaagaggctgagcagacaggagtgtcccacaacttaatgatcacagttgatgatgatggaacaatgagaataaaagatgatgagattgagaacatcctaacagtgcttttaaaaacagcattattaatagtatcaggcatttttccatactccatacccgcaacattgttggtctggcacacttggcaaaaacaaacccaaagatccggcgttttatgggatgtgcccagccccccagagacacagaaagcagaactggaagaaggggtttataggatcaaacagcaaggaatttttgggaaaacccaagtaggggttggagtacagaaagaaggagtcttccacaccatgtggcacgtcacaagaggagcagtgttgacacataatgggaaaagactggaaccaaactgggctagtgtgaaaaaagatctgatttcatatggaggaggatggagactgagcgcacaatggcaaaagggggaggaggtgcaggtcattgccgtagagccagggaagaacccaaagaactttcaaaccatgccaggcactttccagactactacaggggaaataggagcaattgcactggatttcaagcctggaacttcaggatctcctatcataaatagagagggaaaggtagtgggactgtatggcaatggagtggttacaaagaatggtggctatgtcagcggaatagcgcaaacaaatgcagaaccagatgggccgacaccagagttggaagaagagatgttcaaaaagcgaaacctgaccataatggatctccatcctgggtcaggaaagacacggaaataccttccagccattgtcagagaggcaatcaagagacgtttaagaaccttaattttggcaccgacaagggtggtagcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggttccaaattacaacttgataataatggatgaggcccatttcacagacccagccagcatagcggctagagggtacatatcaactcgtgttggaatgggagaggcagccgcaatcttcatgacagcaacaccccctggaacagctgatgcctttcctcagagcaacgctccaattcaagatgaagaaagggacataccagaacgctcatggaattcaggcaatgaatggattactgacttcgccgggaaaacggtgtggtttgtccctagcattaaggccggaaatgacatagcaaactgcttgcgaaaaaacgggaagaaggtcattcaacttagtaggaagacttttgacacagaatatcagaagactaaactgaatgattgggactttgtggtgacgactgacatttcagaaatgggggccaatttcaaagcagatagagtgattgacccaagaagatgcctcaaaccagtgatcttgacagatggaccagagcgggtgatcctggccggaccaatgccagtcaccgcggcgagtgctgcgcaaaggagagggagagttggcaggaacccacaaaaggaaaatgaccagtacatattcacgggccagcctctcaacaatgatgaagaccatgctcactggacagaagcaaaaatgctgctggacaacatcaacacaccagaaggaattttaccagctctctttgaaccagaaagggagaagtcagccgccatagacggtgagtatcgcctgaagggtgagtctaggaagacttttgtggaactcatgaggaggggtgaccttccggtttggttagcccataaagtagcatcagaaggaattaaatatacagatagaaaatggtgctttgatgggcaacgcaataatcaaatcttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacacctagcccacagaacaagaaacgctttggacaatctggtgatgctgcacacgtcagaacatggcggtagggcttacagacatgcggtggaggaactaccagaaacaatggaaacactcctactcttgggacttatgatcttgctgacaggtggagcaatgcttttcttgatatcaggtaaagggattggaaagacttcaataggactcatctgtgtaattgcttccagcggcatgttgtggatggccgaagttccactccaatggattgcgtcggctatagtcctggagttttttatgatggtgttgctcataccagaaccagaaaagcagagaaccccccaagacaaccaacttgcatatgtcgtgataggcatacttacattggctgcaataatagcagccaatgaaatgggactgttggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggctgctatagcaaaccaggcagtggttctgatgggtttggacaaaggatggccaatatcaaaaatggacttgggcgtgccactactagcactgggttgctattcacaagtgaacccactgactctaaccgcggcagtacttttgctaatcacacattatgctatcataggtccaggattgcaagcaaaagccacccgtgaagctcagaaaaggacagctgctggaataatgaaaaatccaacggtggatgggataatgacaatagacctagatcctgtaatatatgattcaaaatttgaaaaacaactaggacaggtcatgctcctggttttgtgcgcagtccaacttttgttaatgagaacatcatgggccttgtgtgaagctttaactctagctacaggaccaataacaacactctgggaaggatcacctggtaagttttggaacaccacgatagctgtttccatggcgaacatttttagagggagctatctagcaggagctgggcttgctttttctattatgaaatcagttggaacaggaaaaagaggaacaggctcacaaggtgaaactttaggagaaaaatggaaaaagaaattaaatcaattatcccggaaagagttcgatctttacaaaaaatctggaattactgaagtggatagaacagaagccaaagaagggttgaaaagaggagagacaacacatcatgccgtgtccagaggtagcgcaaaacttcaatggtttgtggaaagaaacatggtcgttcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagcggaaaggatgtgttctacctcccacctgaaaagtgtgataccctgttgtgtgacattggagaatcttcaccaagcccaacagtggaagagagtagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgttactgaacaggttcacgatgacacacaggagacccaccatagagaaagatgtggatttaggagcaggaacccgacatgttaatgcggaaccagaaacacccaacatggatgtcattggggaaagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaacttctcactaaaccatgggatgtggtgcccatggtgacacagatggcaatgacagacacaactccatttggccagcagagagtctttaaagagaaagtggacaccaggacgcccaggcccatgccagggacaagaaaggttatggaaatcacagcggagtggctctggagaaccctgggaaggaacaaaagacccaggttatgcacaagggaagagttcacaaaaaaggtcagaactaacgcagccatgggcgctgttttcacagaggagaaccaatgggacagtgcgaaagctgctgttgaggatgaagaattttggaaacttgtggacagagaacgtgaactccacaaattgggcaaatgtggaagctgcgtttataacatgatgggtaagagagagaaaaaacttggagagtttggcaaagcaaaaggcagtagagctatatggtacatgtggttgggagccaggtaccttgagttcgaagcccttggattcttaaatgaagaccactggttctcacgtgaaaactcttacagtggagtagaaggagaaggactgcacaagctaggctatatattaagggacatttccaagatacccggaggagccatgtatgcagatgacacagctggttgggacacaagaataacagaagatgacctgcacaatgaggaaaagatcatacagcaaatggaccctgaacacaggcagttagcgaacgctatattcaagctcacataccaaaacaaagtggttaaagttcaacgaccgactccaacgggtacggtaatggacattatatctaggaaagaccaaaggggcagtggacaagtgggaacttatggcttgaacacattcaccaacatggaagcccagttagtcagacaaatggaaggagaaggtgtgctgacaaaggcagacctcgagaactctcatctgccagagaagaaaattacacaatggttggaaaccaaaggagtggagaggttaaaaagaatggccattagcggagatgattgcgtggtgaaaccaatcgatgataggttcgctaatgctctggttgccctgaacgatatgggaaaggttcggaaagacatacctcaatggcagccatcaaggggatggcatgattggcaacaggtccctttctgctcccaccactttcatgaattgatcatgaaagatggaagaaagttagtggttccctgcagaccacaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgctcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacttgggaaaatgttccatatctagggaagagagaagaccaatggtgtggatcacttattggtctcacttccagagcaacctgggcccagaacatacccacagcaattcaacaggtgagaagccttataggcaatgaagagttcttggactatatgccttcaatgaagaggttcaggaaggaagaggagtcggagggggccatttggtaa

SEQ ID NO: 7713 - RNA, 9873 nt, synthetic construct
  misc_feature 1..9873: note = derived and/or modified CDS sequence (wt) from DENV-3__KC762681__SS-prME
  source 1..9873: mol_type = other RNA
acatcgctctgcctcatgatgatgttaccagcaacacttgctttccacttgacttcacgagatggagagccgcgcatgattgtggggaagaatgaaagagggaaatcccttctcttcaagacagcctctggaattaatatgtgcacactcatagccatggatttgggagagatgtgtgatgacacggtcacttacaaatgcccccttatcactgaagtggagcctgaggacattgactgctggtgcaacctcacatcgacgtgggtgacctacggaacgtgcaaccaagctggagagcatagacgcgataagagatcggtggcgttagctccccatgtcggcatgggactggacacacgcacccaaacctggatgtcggctgaaggagcttggagacaagttgagaaggtagagacatgggcttttaggcacccagggttcacaatactagccctatttcttgcccattacataggcacttccttgacccagaaagtggtcattttcatactactgatgctggtcaccccatccatgacaatgagatgtgtgggagtaggaaacagagacttcgtggaaggcctatcaggagctacgtgggttgatgtggtgctcgagcacggtgggtgtgtgactaccatggctaagaacaagcccacgctagatatagagctccagaagaccgaggccacccaactggcgaccctaaggaaactatgtattgaggggaaaatcaccaacgtaacaaccgactcaaggtgccccacccaaggggaagcgattttacctgaggaacaggaccagaactacgtgtgtaagcacacatacgtggacagaggctgggggaacggttgtggtttgtttggcaagggaagcttggtaacatgcgcgaagtttcaatgtttggaatttatagagggaaaagtggtgcagcatgagaacctcaaatacactgtcatcatcacagtgcacacaggagaccaacatcaggtgggaaatgaaacccagggagtcacggctgagataacacctcaggcatcaaccgtcgaagccatcttacctgaatatggaacccttgggctagaatgctcaccacggacaggtttggattttaatgaaatgattttgttgacaatgaagaacaaagcatggatggtacatagacagtggttttttgacctacctctaccatggacatcaggggccacaacagaaacaccaacctggaacaagaaagagcttcttgtgacatttaaaaatgcacacgcaaagaaacaagaagtagtagttcttggatcgcaagagggagcaatgcacacagcactgacaggagccacagagatccaaacctcaggaggcacaagtatttttgcggggcatttaaagtgcagactcaagatggacaaattggaactcaaggggatgagctatgcaatgtgcttaaatgcctttgtgttgaagaaagaagtctccgaaacacaacatgggacaatactcattaaggttgagtacaaaggagaagatgcaccttgcaagattcctttctccacggaggatggacagggaaaagcccacaatggcagactgatcacagctaacccagtggtgaccaagaaggaggagcctgtcaatattgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattagggaaaatggtgcaccaaatatttggaagtgcttacacggccctatttagtggagtctcctggataatgaaaattggaataggcgtccttttaacctggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagcgggattttcgttaccaatgaggtccacacctggacagagcaatacaaatttcaagcagactcccctaagagactggcaacagccattgcaggcgcctgggaaaatggagtgtgcggaatcaggtcgacaaccagaatggagaaccttttgtggaagcaaatagccaatgaactgaactacatattatgggaaaacaacatcaaattgacggtagttgtgggtgatataattggggtcttagagcaagggaaaagaacactgacaccacaacccatggatctaaaatattcgtggaaaacatggggaaaggcgaaaatagtgacagctgagacacaaaattcctccttcataatagatgggccaaacacaccagagtgtccaagtgcctcaagagcatggaatgtgtgggaggtggaagattacgggttcggagtcttcacaactaatatatggctgaaactccgagagatgtacactcaactatgcgaccacaggctaatgtcggcagccgttaaggatgagagagccgtacacgccgacatgggctattggatagaaagccaaaagaatggaagttggaaactagaaaaggcatccctcatagaggtgaaaacctgcacatggccaaaatcacacactctctggagcaatggcgtgctggagagtgacatgatcatcccaaagagtctggctggtcctgtttcgcaacacaactacaggcccggatatcacacccaaacggcaggaccttggcacctaggaaaattggagctggatttcaactattgtgaaggaacaacagttgtcatcacagaaaattgtgggacaagaggcccatcactgaggacaacaacagtgtcagggaagttgatacacgaatggtgttgccgctcatgtacacttcctcccctgcgatacatgggagaagacggctgttggtatggcatggaaattagacccattaatgagaaagaagagaacatggtaaagtctttagtctcagcagggagtggaaaggtggataacttcacaatgggtgttttatgtttggcaatcctctttgaagaggtgatgagaggaaaattcggaaaaaagcacatgattgcaggggttctctttacatttgtgctccttctctcagggcagataacatggagagatatggcgcgcacactcataatgattgggtccaacgcctctgacagaatgggaatgggcgtcacttacttagcattgattgcaacatttaaaattcagccatttttggctttgggattcttcctgaggaaactgacatctagagaaaatttattgttgggagttgggctggccatggcaacaacgttacaactgccagaggacattgaacaaatggcgaatggaatagctttggggctcatggctctcaaattgataacacaatttgaaacatatcaactatggacggcattagtttccctaatgtgttcaaacacaatgttcacgttgactgttgcctggagaacagccaccctgattttggccggaatttcgcttttgccagtgtgccagtcttcgagcatgaggaaaacagattggcttccagttactgtggcagccatgggagttccacccctaccactgtttatcttcagtttgaaagatacgctcaaaaggagaagctggccactaaatgagggggtgatggccgttggacttgtgagcattctagcaagttctctccttaggaatgacgtacccatggctggaccattggtggctgggggcttgctgatagcgtgctacgttataactggcacgtcagcagacctcactgtagaaaaagcagcagatgtgatatgggaggaagaggctgagcaaacaggagtgtcccacaatttaatgatcacagttgatgatgatggaacaatgagaataaaagatgatgagactgagaacatcctaacagtgctattgaaaacagcattactaatagtgtcaggcatttttccatactccatacccgctacactgttggtctggcacacttggcaaaagcaaacccaaagatccggcgtcctatgggacgtgcccagccccccagagacacagaaagcagaactggaagaaggggtttataggatcaagcagcaaggaatttttgggaagacccaagtgggggttggagtacaaaaagaaggagttttccacaccatgtggcacgtcacaagaggagcagtgctgacacacaacgggaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaacttccaaaccatgccaggcattttccagacaacaacaggagagataggagcgattgcactggacttcaagcctgggacttcaggatctcccatcataaacagagagggaaaggtagtgggactgtatggcaatggagtggtcacaaagaatggtggctatgtcagtggaatagctcaaacaaacgcagaaccagacggaccgacaccagagttggaagaagagatgttcaagaagcgaaatctaaccataatggatctccatcccgggtcaggaaagacgcggaaatacctcccagctattgttagagaagcaatcaaaagacgcttaaggactctaattttggcaccaacaagggtggtcgcagctgagatggaagaagcattgaaagggctcccaataaggtaccaaacaactgcaacaaaatctgcacacacagggaaagagattgttgatctaatgtgtcacgcaacattcacaatgcgtttattgtcaccagtcagagttccaaactataacttgataataatggatgaggctcattttacagacccagctagcatagcggctagagggtacatatcaactcgtgtaggaatgggagaggcagctgcaattttcatgacagccacgccccctggcacagctgatgcctttcctcagagcaatgccccaattcaagatgaagaaagagacataccagaacgctcatggaattcaggtaatgaatggattaccgactttgccgggaagacggtgtggtttgtccctagcatcaaagctggaaatgacatagcaaactgcttgcggaaaaatggaaaaaaggtcattcaacttagtaggaagacttttgacacagaatatcaaaagactaaactaaatgattgggactttgtggtgacaacagacatttcagaaatgggagccaatttcaaaacagacagagtgatcgacccaagaagatgtctcaagccagtcattttgacagacggacccgagcgcgtgatcctggcgggaccaatgccagtcaccgtagcgagcgccgcgcaaaggagagggagagttggcaggaacccacaaaaggaaaatgaccaatacatattcacgggccagcccctcaataatgatgaagaccacgctcactggacagaagcaaaaatgctgctagacaacatcaacacaccagaagggattataccagctctctttgaaccagaaagggagaagtcagccgccatagacggcgaataccgcctgaaaggtgaatccaggaagaccttcgtggaactcatgaggaggggtgacctcccagtttggctagcccataaagtagcatcagaaggaatcaaatatacagacagaaaatggtgctttgatggagaacgcaacaaccaaattttagaagaaaatatggatgtggaaatctggacaaaggaaggagaaaagaaaaaattgaggcctaggtggcttgatgcccgcacctattcagatcccttagcgctcaaggaattcaaggactttgcggctggtagaaagtcgatcgctcttgatcttgtgacagaaataggaagagtgccttcacacctagcccacagaacgagaaacgctctggacaatctggtgatgttgcacacgtcagaacatggtgggagggcttacaggcatgcagtggaggaattaccagaaacaatggaaacactcttactcctgggactcatgatcctgttaacaggtggggcaatgcttttcttgatatcaggtaaagggattggaaagacttcaataggactcatttgtgtagttgcttccagcggtatgttatggatggctgatgtcccactccaatggatcgcgtcggccatagtcctggagttttttatgatggtgctacttataccagaaccagaaaagcagagaactccccaagacaatcaactcgcatatgttgtgataggcatactcacattggctgcaatagtggcagccaatgaaatgggattgttggaaaccacaaagagagatttaggaatgtccaaagaaccaggtgttgtttctccaactagctatttggatgtggatttgcacccagcatcagcctggacattgtacgctgtggccacaacagtaataacaccaatgttgagacacaccatagagaactccacagcaaatgtgtccctggcagctatagccaaccaggcagtggtcctgatgggtttagacaaaggatggccgatatcaaaaatggacttaggcgtaccactattggcactgggttgctattcgcaagtgaacccactaactctcacagcggcagtactcctgctagtcacgcattacgccattataggtccaggattgcaggcaaaagccactcgtgaagcccaaaaaaggacagctgctggaataatgaagaatccaacggtggatgggataatgacaatagacctagatcctgtaatatacgattcaaaatttgaaaagcaactaggacaggttatgctcctggttctgtgtgcagttcaacttttgttaatgagaacatcctgggcattttgtgaagctctaaccctagccacaggaccaataacaacactctgggaagggtcacctgggaagttctggaacaccacgatagctgtttccatggcgaacatctttagagggagctatttagcaggagctgggcttgctttttctatcatgaaatcagttggaacaggaaagagaggaacagggtcacaaggtgaaaccttgggagaaaagtggaaaaagaaattgaatcaattatctcggaaagaatttgacctttacaagaaatccggaatcactgaagtggatagaacagaagccaaagaagggttgaaaagaggagaaataacacaccatgccgtatccagaggcagcgcgaaacttcaatggttcgtggagagaaatatggtcatccctgaaggaagagtcatagacttgggctgtggaagaggaggctggtcatattattgtgcaggactgaaaaaagttacagaagtgcgaggatacacaaaaggcggcccaggacatgaagaaccagtacctatgtctacatacggatggaatatagtcaagctaatgagtggaaaggatgtgttttatcttccacctgaaaagtgtgacactctattgtgtgacattggagaatcttcaccaagcccaacagtggaagaaagcagaaccataagagtcttgaagatggttgaaccatggctaaaaaataaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaatatcgtctcttcagtcaacatggtatccagactgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcacagttcaacatggcactatgatgaagaaaatccttataaaacgtgggcttaccatggatcctatgaagttaaggccacaggctcagcctcctccatgataaatggagttgtgaaactcctcacgaaaccatgggatgtggtgcccacggtgacacagatggcaatgacggatacaacccctttcggccagcaaagggttttcaaagagaaagtggacaccaggacacctagacccatgccaggaacaagaaaggctatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgcgtctacaacatgatgggcaagagagagaagaaactcggagagtttggcaaagcaaaaggcagtagagccatatggtacatgtggttgggagctaggtaccttgagttcgaggcgctcggattcttaaatgaagaccattggttctcgcgtgaaaactctttcagtggagtagaaggggaaggactgcataaactgggatacatcttgagagacatttccaagatacccggaggagctatgtatgctgatgacacagctggttgggacacaagaataacagaagatgacctgcataacgaggaaaaaatcacgcagcaaatggaccctgaacacaggcaattagcaaacgccatatttaagctcacataccaaaacaaagtggtcaaggttcaacgaccaactccaaagggcacggtgatggacatcatatctaggaaagaccaaagaggcagcggacaggtgggaacttatggtctgaatacattcaccaacatggaagttcagttaatcagacaaatggaaggagaaggtgtgctgtcgaaggcagacctcgagaaccctcatctgctagagaaggaaattacacaatggttggaaactaaaggagtggagaggttaaaaagaatggccatcagcggggatgattgcgtggtgaaaccaatcgatgacaggttcgccgatgccctgcttgccctgaatgacatggggaaagttaggaaggacatacctcaatggcagccatcgaagggatggcatgattggcaacaggttcctttctgctcccaccactttcatgaattgatcatgaaagatggaagaaagttggtagtcccctgcagacctcaggatgaattaatagggagagcgagaatttctcaaggagcaggatggagccttaaagaaactgcatgcctggggaaagcctacgcccaaatgtgggctctcatgtattttcacagaagagatctcagactagcatccaacgccatatgttcagcagtacctgtccactgggtccccacaagcaggacgacgtggtccattcatgctcaccatcagtggatgactacagaggacatgcttactgtttggaacagggtgtggatagaggacaatccatggatggaagataaaactccagttacaacttgggaagatgttccatatctagggaagagagaagaccaatggtgcggatcactcattggtcttgcttccagagcaacctgggcccaaaacatacttaccgcaatccaacaggtaagaagccttataggcaatgaagagtttctggactacatgccttcgatgaagagattcaggaaggaggaggagtcagagggagccatttggtaa

SEQ ID NO: 7714 - RNA, 9873 nt, synthetic construct
  misc_feature 1..9873: note = derived and/or modified CDS sequence (wt) from DENV-3__KC762684__SS-prME
  source 1..9873: mol_type = other RNA
acatcgctctgtctcatgatgatgttaccagcaacacttgctttccacttgacttcacgagatggagagccgcgcatgattgtagggaagaatgaaagaggaaaatccctactttttaagacagcctctggaatcaacatgtgcacactcatagccatggatttgggagaaatgtgtgatgacacggtcacttacaaatgcccccttattactgaagtggagcctgaagacattgactgctggtgcaatctcacatcgacgtgggtgacctacggaacgtgcaaccaagctggagagcatagacgcgataagagatcggtggcgttagctcctcatgtcggcatgggactggacacacgcgcccaaacctggatgtcggctgaaggagcttggagacaagttgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgactaccatggccaagaacaagcccacgctggacatagagctccagaagaccgaggccacccaactggcaaccctaaggaaactatgcattgagggaaaaatcaccaacgtgacaaccgactcaaggtgccccacccaaggggaagcaattctacctgaggagcaggaccagaactacgtgtgtaagcacacatacgtggacagaggctggggaaacggttgtggtttgtttggcaagggaagcttggtaacatgcgcaaaatttcaatgtttggaattaatagagggaaaagtggtgcagcatgagaaccttaaatacaccgtcagcatcacagtgcacacaggagaccaacaccaggtgggaaatgaaacacagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtacatagacaatggttttttgacctacctctaccatggacatcaggggctacaacagaaacaccaacctggaacaagaaagagcttcttgtgacattcaaaaacgcacacgcaaaaaaacaagaagtagtagtccttggatcgcaagagggagcaatgcacacagcactaacaggagctacagagatccaaacctcaggaggcacaagcatttttgcggggcacttgaaatgcagactcaagatggacaaattggaactcaaggggatgagctatgcaatgtgctcaaatgcctttgtgttgaagaaagaagtctctgaaacacagcatgggacaatactcattaaggttgagtacaaaggggaagacgcaccttgcaagattcccttctccacggaggatggacaagggaaagcccacaatggcagactgatcacagccaacccagtggtgaccaagaaggaggagcctgtcaatattgaggcagaacctcctttcggggaaagtaacataataattggaattggagacaaagccctgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatattcggaagtgcttacacggccctttttagtggagtctcctggataatgaaaattggaataggtgtccttttaacttggatagggttgaattcaaaaaacacttctatgtcattttcatgcattgtgataggaatcatcacactctatctgggagccgtggtgcaagctgacatggggtgtgtcataaactggaaaggcaaagaactcaagtgtggaagtggaattttcgttactaatgaggtccacacctggacagagcaatacaaatttcaagcagactcccccaaaagactggcgacagccattgcaggcgcctgggagaatggagtgtgcggaatcaggtcgacaaccagaatggagaacctcttgtggaagcagatagccaatgaactaaactacatattatgggaaaacaacatcaaattaacggtagttgtgggtgatataattgggatcttagagcaagggaaaagaacactaacaccacaacccatggagctaaaatattcatggaaaacatggggaaaggcgaaaatagtgacagctgaaatgcaaaattcctcctttataatagatgggccaaacacaccagagtgtccaaatgcctcaagagcatggaatgtgtgggaggtggaagactacgggttcggagtcttcacaactaatatatggctgaaactccgggaaatgtacacccaactatgtgatcacaggctaatgtcggcagccattaaggatgagagagccgtacacgccgacatgggctattggatagaaagccaaaagaatggcagttggaaactagaaaaggcatctctcatagaggtgaaaacctgcacatggccaaaatcacacactctctggagcaatggtgtgttggagagtgacatgatcatcccaaagagtctggctggtcccatctcgcaacacaattacaggcccggataccacacccaaacggcaggaccatggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatacatgggagaagacggctgctggtatggcatggaaattagacccattaatgagagagaagagaacatggtaaagtctttagtctcagcagggagtggaaaggtggataacttcacaatgggtgtcttgtgtcttgcaatcctctttgaagaggtaatgaggggaaaattcgggaaaaagcacatgattgcaggggttttcttcacatttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcttgaggaaactgacatctagagaaaatttattattgggagttgggttggccatggcaacaacgttgcaactgccagaggacattgaacaaatggcgaatggaatagccctggggctcatggctcttaaattggtaacacaatttgaaacataccaactatggacagcattagtctccctaatgtgttcaaacacaattttcacgttgactgttgcctggagaacagccaccctgattttggccggaatttcgcttttgccactgtgccagtcttcgggcatgaggaaaacagattggctcccaatgactgtggcagctatgggagttccacctctaccactctttattttcagtttgaaagacacactcaaaaggagaagctggccactgaatgagggggtgatggccgttggacttgtgagcattctagcaagttctcttcttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctacaggatcaagcagcaaggaatttttggaaagacccaagtgggagttggagtacaaaaagaaggagttttccacaccatgtggcacgtcacaagaggagcagtgttgacatacaatggaaaaagactggaaccaaactgggctagcgtgaaaaaagatctgatttcatacggaggaggatggagactgagtgcacaatggcaaaaaggagaagaggtgcaggttatcgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaagcgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggaccctaattttggcaccaacaagggtggtcgcagctgagatggaagaagcattgaaagggcttccaataaggtatcaaacaactgcaacaaaatctgaacatacagggaaagagattgttgatctaatgtgtcacgcaacgttcacaatgcgtttgctgtcaccagtcagagttccaaactacaacctgataataatggatgaggctcatttcacagacccagccagtatagcggctagagggtacatatcaactcgtgtaggaatgggagaggcagccgcaatcttcatgacagccacacctcctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctgggaatgacatagcaaactgcttgcggaaaaatggaaaaaaggtcattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatatttacgggccagcctctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtggcatcagaaggaatcaaatacacagacagaaaatggtgttttgatggagagcgcaacaaccaaattttagaggagaatatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatttagctcacagaacgagaaacgctctggacaatctggtgatgttgcacacgtcagaacacggtgggagggcctacaggcatgcagtggaggaattaccagaaacaatggaaacacttctactcctgggacttatgatcctgttaacaggtggggtgatgcttttcttgatatcaggcaaaggggttggaaagacttcaataggactcatttgtgtagttgcttccagcagcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaacgaaatgggattgttggaaaccacaaagagagatttggggatgtccaaagaaccaggtgttgtttcgccaaccagctatttggatgtggatttgcacccagcatcagcctggacactgtatgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggttgctattcacaagtgaacccactaactctcacagcggcagtgctcctgctagtcacgcattatgctattataggtccaggattgcaagcaaaagccactcgtgaagctcaaaaaaggacggcagctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttctggaatactacgatagctgtttccatggcgaacatctttagggggagctatttagcaggagctggacttgctttttctatcatgaaatcagttggaacaggaaagagaggaacagggtcacaaggtgaaactttgggagaaaagtggaaaaagaaattgaatcaattatcccggaaagagtttgacctctacaagaaatccggaatcactgaagtggatagaacagaagccaaagaagggttaaaaagaggagaaataacacaccatgccgtatctagaggcagcgcaaaacttcaatggttcgtggagagaaacatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtccacatatggatggaacatagtcaagctgatgagtggaaaggatgtgttttatcttccacctgaaaagtgtgacactctattatgtgacattggagaatcttcaccaagtccaacagtggaggagagcagaaccataagagtcttgaaaatggtcgaaccatggctaaaaaataaccagttttgcattaaagtattgaacccttacatgccagctgtgattgagcacctagaaagactacaaaggaaacatggaggaatgcttgtgagaaatccactctcacgaaattccacgcacgaaatgtactggatatccaatggcacaggcaacatcgtctcttcggtcaacatggtatccagactgctactgaacagattcacgatgacatataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcttcctccatgataaatggagtcgtgaaactcctcacgaaaccatgggatgtggtgcccacggtgacacagatggcaatgacagacacgaccccttttggccagcaaagggtttttaaagagaaagtggacaccaggacacccaaacccatgccaggaacaagaaaggttatggagatcacagcggaatggctttggagaaccctgggaaggaacaaaagaccaagattatgcacgagagaggagttcacaaagaaggtcagaaccaacgcagctatgggcgccgtgttcacagaggagaaccaatgggacagtgctagagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgacacagctgggtgggacacaagaataacagaagatgacctgcacaatgaggaaaaaatcacacagcaaatggaccccgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtagagaggttaaaaagaatggccatcagcggggatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattaatagggagagcgagaatctctcagggagcaggatggagccttaaagaaactgcatgcctaggaaaagcctacgcccaaatgtgggctctcatgtattttcacagaagagatcttagactagcatccaatgccatatgttcagcagtaccagtccattgggtccccacaagcagaacgacgtggtccatccatgctcaccatcagtggatgactacagaagacatgcttactgtttggaatagggtgtggatagaggacaatccatggatggaagacaaaactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagtcagagggagccatttggtaa

SEQ ID NO: 7715 - RNA, 9873 nt, synthetic construct
  misc_feature 1..9873: note = derived and/or modified CDS sequence (wt) from DENV-3__KC762686__SS-prME
  source 1..9873: mol_type = other RNA
acatcgctctgcctcatgatgatgttaccagcaacacttgctttccacctgacttcacgagatggagagccgcgcatgattgtggggaagaatgaaagagggaaatcccttctcttcaagacagcctctggaattaatatgtgcacactcatagccatggatttgggagagatgtgtgatgacacggtcacttacaaatgcccccttatcactgaagtggagcctgaggacattgactgctggtgcaacctcacatcgacgtgggtgacctacggaacgtgcaaccaagctggagagcatagacgcgataagagatcggtggcgttagctccccatgtcggcatgggactggacacacgcgcccaaacctggatgtcggctgaaggagcttggagacaagttgagaaggtagagacatgggcttttaggcacccagggttcacaatactagccctatttcttgcccattacataggcacttccttgacccagaaagtggtcattttcatactactgatgctggtcaccccatccatgacaatgagatgtgtgggagtaggaaacagagatttcgtggaaggcctatcaggagctacgtgggttgacgtggtgctcgagcacggtgggtgtgtgactaccatggctaagaacaagcccacgctagatatagagctccagaagaccgaggccacccaactggcgaccctaaggaaactatgtattgaggggaaaatcaccaacgtaacaaccgactcaaggtgccccacccaaggggaagcgattttacccgaggaacaggaccagaactacgtgtgtaagcacacatacgtggacagaggctgggggaacggttgtggtttgtttggcaagggaagcttggtaacatgcgcgaagtttcaatgtttggaatttatagagggaaaagtggtgcagcatgagaacctcaaatacaccgtcatcatcacagtgcacacaggagaccaacatcaggtgggaaatgaaacgcagggagtcacggctgagataacacctcaggcatcaaccgtcgaagccatcttacctgaatatggaacccttgggctagaatgctcaccacggacaggtttggatttcaatgaaatgattttgttgacaatgaagaacaaagcatggatggtacatagacagtggtttttcgacctacctctaccatggacatcaggggccacaacagaaacaccaacctggaacaagaaagagcttcttgtgacatttaaaaatgcacacgcaaagaaacaagaagtagtagtccttggatcgcaagagggagcaatgcacacagcactgacaggagccacagagatccaaacctcaggaggcacaagtatttttgcggggcatttaaagtgcagactcaagatggacaaattggaactcaaggggatgagctatgcaatgtgcttaaatgcctttgtgttgaagaaagaagtctccgaaacacaacatgggacaatactcattaaggttgagtacaaaggggaagatgcaccttgcaagattcctttctccacggaggatggacagggaaaagcccacaatggcagactgatcacagctaacccagtggtgaccaagaaggaggagcctatcaatattgaggcagaacctccttttggggaaagtaacatagtaattggaattggagacaaagctttgaaaatcaactggtacaagaagggaagctcgattgggaagatgttcgaggccactgccagaggtgcaaggcgcatggccatcttgggagacacagcctgggactttggatcagtaggtggtgttttaaattcattagggaaaatggtgcaccaaatatttggaagtgcttacacggccctatttagtggagtctcttggataatgaaaattggaataggcgtccttttaacctggatagggttgaattcaaaaaacacttctatgtcattttcatgcattgtgatagggatcatcacactctatctgggagccgtggtgcaagctgacatggggtgtgtcataaactggaaaggcaaagaactcaaatgtggaagcgggattttcgttaccaatgaggtccacacctggacagagcaatacaaatttcaagcagactcccctaagagactggcaacaaccattgcaggcgcctgggaaaatggagtgtgcggaatcaggtcgacaaccagaatggagaaccttttgtggaagcaaatagccaatgaactgaactacatattatgggaaaacaacatcaaattgacggtagttgtgggtgatataattggggtcttagagcaagggaaaagaacactgacaccacaacccatggagctgaaatattcgtggaaaacatggggaaaggcgaaaatagtgacagctgagacacaaaattcctccttcataatagatgggccaaacacaccagagtgtccaagtgcctcaagagcatggaatgtgtgggaggtggaagattacgggttcggagtcttcacaactaatatatggctgaaactccgagagatgtacacccaactatgtgaccacaggctaatgtcggcagctgttaaggatgagagagccgtacacgccgacatgggctattggatagagagccaaaagaatggaagttggaaactagaaaaggcatccctcatagaggtgaaaacctgcacatggccaaaatcacacactctctggagcaatggcgtgctggagagtgacatgatcatcccaaagagtctggctggtcctgtttcgcaacacaaccacaggcccggatatcacacccaaacggcaggaccttggcacctaggaaaattggagctggatttcaactattgtgaaggaacgacagttgtcatcacagaaaattgtgggacaagaggcccatcactgaggacaacaacagtgtcagggaagttgatacacgaatggtgttgccgctcatgtacacttcctcccctgcgatacatgggagaagacggctgttggtatggcatggaaattagacccattaatgagaaagaagagaacatggtaaagtctttagtctcagcagggagtggaaaggtggataacttcacaatgggtgttttatgtctggcaatcctctttgaagaggtgatgagaggaaaattcggaaaaaagcacatgattgcaggggttctctttacatttgtgctccttctctcagggcagataacatggagagatatggcgcgcacactcataatgattgggtccaacgcctctgacagaatgggaatgggcgtcacttacctagcattgattgcaacatttaaaattcagccatttttggctttgggattcttcctgaggaaactgacttctagagaaaatttattgttgggagttgggctggccatggcaacaacgttacaactgccagaggacattgaacaaatggcgaatggaatagctttggggctcatggctctcaaattgataacacaatttgaaacatatcaactatggacggcattagtttccctaatgtgttcaaacacaattttcacgttgactgttgcctggagaacagccaccctgattttggccggaatttcgcttttgccagtgtgccagtcttcgagcatgaggaaaacagattggctcccagttactgtggcagccatgggagttccacccctaccactgtttatcttcagtttgaaagatacgctcaaaaggagaagctggccactaaatgagggggtgatggccgttggacttgtgagcattctagcaagttctctccttaggaatgacgtacccatggctggaccattagtggctgggggcttgctgatagcgtgctacgttataactggcacgtcagcagacctcactgtagaaaaagcagcagatgtgatatgggaggaagaggctgagcagacaggagtgtcccacaatttaatgatcacagttgatgatgatggaacaatgagaataaaagatgatgagactgagaacatcctaacagtgctattgaaaacagcattactaatagtgtcaggcatttttccatactccatacccgctacactgttggtctggcacacttggcaaaagcaaacccaaagatccggcgtcctatgggacgtacccagccccccagagacacagaaagcagaactggaagaaggggtctataggattaagcagcaaggaatttttgggaagacccaagtgggggttggagtacaaaaagaaggagttttccacaccatgtggcacgtcacaagaggagcagtgctgacacacaacgggaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaacttccaaaccatgccaggcattttccagacaacaacaggagagataggagcgattgcactggactttaagcctgggacttcaggatctcccatcataaacagagagggaaaggtagtgggactgtatggcaatggagtggtcacaaagaatggtggctatgtcagtggaatagctcaaacaaacgcagaaccagacggaccgacaccagagttggaagaagagatgttcaagaagcggaatctaaccataatggatctccatcccgggtcaggaaagacgcggaaatacctcccagctattgttagagaagcaatcaaaagacgcttaaggactctaattttggcaccaacaagggtggtcgcagctgagatggaagaagcattgaaggggctcccaataaggtatcaaacaactgcaacaaaatctgcacacacagggaaagagattgttgatctaatgtgtcacgcaacattcacaatgcgtttactgtcaccagtcagagttccaaactataacttgataataatggatgaggctcattttacagacccagctagcatagcggctagagggtacatatcaactcgtgtaggaatgggagaggcagccgcaattttcatgacagccacgccccctggcacagctgatgcctttcctcagagcaatgccccaattcaagatgaagaaagagacataccagaacgctcatggaattcaggtaatgaatggattaccgactttgccgggaagacggtgtggtttgtccctagcatcaaagctggaaatgacatagcaaactgcttgcggaaaaatggaaaaaaggtcattcaacttagtaggaagacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagcgccgcgcaaaggagagggagagttggcaggaacccacaaaaggaaaatgaccaatacatattcacgggccagcccctcaataatgatgaagaccacgctcactggacagaagcaaaaatgctgctagacaacatcaacacaccagaagggattataccagctctctttgaaccagaaagggagaagtcagctgccatagacggcgaataccgcctgaaaggtgaatccaggaagaccttcgtggaactcatgaggaggggtgacctcccagtttggctagcccataaagtagcatcagaaggaatcaaatatacagacagaaaatggtgctttgatggagaacgcaacaaccaaattttagaagaaaatatggatgtggaaatctggacaaaggaaggagaaaagaaaaaattgaggcctaggtggcttgatgcccgcacctattcagatcccttagcgctcaaggaattcaaggactttgcggctggtagaaagtcgatcgctcttgatcttgtgacagaaataggaagagtgccttcacacctagcccacagaacgagaaacgctctggacaatctggtgatgttgcacacgtcagaacatggtgggagggcttacaggcatgccgtggaggaattaccagaaacaatggaaacactcttactcctgggactcatgatcctgttaacaggtggggcaatgcttttcttgatatcaggtaaagggattggaaagacttcaataggactcatttgtgtggttgcttccagcggtatgttatggatggctgatgtcccactccaatggatcgcgtcggccatagtcctggagttttttatgatggtgctacttataccagaaccagaaaagcagagaactccccaagacaatcaactcgcatatgttgtgataggcatactcacattggctgcaatagtggcagccaatgaaatgggattgttggaaaccacaaagagagatttaggaatgtccaaagaaccaggtgttgtttctccaactagctatttggatgtggatctgcacccagcatcagcctggacattgtacgctgtggccacaacagtaataacaccaatgttgagacacaccatagagaattccacagcaaatgtgtccctggcagctatagccaaccaggcagtggtcctgatgggtttagacaaaggatggccgatatcgaaaatggacttaggcgtaccactattggcactgggttgttattcgcaagtgaacccactaactctcacagcggcagtactcctgctagtcacgcattacgccattataggtccaggattgcaggcaaaagccactcgtgaagcccaaaaaaggacagctgctggaataatgaagaatccaacggtggatgggataatgacaatagacctagatcctgtaatatacgattcaaaatttgaaaagcaactaggacaggttatgctcctggttctgtgtgcagttcaacttttgttaatgagaacatcctgggcattttgtgaagctctaaccctagccacaggaccaataacaacactctgggaagggtcacctgggaagttctggaacaccacgatagctgtttccatggcgaacatctttagagggagctatttagcaggagctgggcttgctttttctatcatgaaatcagttggaacaggaaagagaggaacagggtcacaaggtgaaaccttgggagaaaagtggaaaaagaaattgaatcaattatctcggaaagaatttgacctttacaagaaatccggaatcactgaagtggatagaacagaagccaaagaagggttgaaaagaggagaaataacacaccatgccgtatccagaggcagcgcgaaacttcaatggttcgtggagagaaacatggtcatccctgaaggaagagtcatagacttgggctgtggaagaggaggctggtcatattattgtgcaggactgaaaaaagttacagaagtgcgaggatacacaaaaggcggcccaggacatgaagaaccagtacctatgtctacatacggatggaacatagtcaagctaatgagtggaaaggatgtgttttatcttccacctgaaaagtgtgacactctattgtgtgacattggagaatcttcaccaagcccaacagtggaagaaagcagaaccataagagtcttgaagatggttgaaccatggctaaaaaataaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcacagttcaacatggcactatgatgaagaaaatccttataaaacgtgggcttaccatggatcctatgaagttaaggccacaggctcagcctcctccatgataaatggagttgtgaaactcctcacgaaaccatgggatgtggtgcccacggtgacacagatggcaatgacggatacaacccctttcggccagcaaagggttttcaaagagaaagtggacactaggacacctagacccatgccaggaacaagaaaggctatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgcgtctacaacatgatgggcaagagagagaagaaactcggagagtttggcaaagcaaaaggcagtagagccatatggtacatgtggttgggagctaggtaccttgagttcgaggcgctcggattcttaaatgaagaccattggttctcgcgtgaaaactctttcagtggagtagaaggggaaggactgcataaactgggatacatcttgagagacatttccaagataccaggaggagctatgtatgctgatgacacagctggttgggacacaagaataacagaagatgacctgcataacgaggaaaaaatcacgcagcaaatggagcctgaacacaggcaattagcaaacgccatatttaagctcacataccaaaacaaagtggtcaaggttcaacgaccaactccaaagggcacggtgatggacatcatatctaggaaagaccaaagaggcagcggacaggtgggaacttatggtctgaacacatttaccaacatggaagttcagttaatcagacaaatggaaggagaaggtgtgctgtcgaaggcagacctcgagaaccctcatctgctagagaaggaaattacacaatggttggaaactaaaggagtggagaggttaaaaagaatggccatcagcggggatgattgcgtggtgaaaccaatcgatgacaggttcgccgatgccctgcttgccctgaatgacatggggaaagttaggaaggacatacctcaatggcagccatcgaagggatggcatgattggcaacaggttcctttctgctcccaccactttcatgaattgatcatgaaagatggaagaaagttggtagtcccctgcagacctcaggatgaattaatagggagagcgagaatttctcaaggagcaggatggagccttaaagaaactgcatgcctggggaaagcctacgcccaaatgtgggctctcatgtattttcacagaagagatctcagactagcatccaacgccatatgttcagcagtacctgtccactgggtccccacaagcaggacgacgtggtccattcatgctcaccatcagtggatgaccacagaggacatgcttactgtttggaacagggtgtggatagaggacaatccatggatggaagataaaactccagtcacaacttgggaagatgttccatatctagggaagagagaagaccaatggtgcggatcactcattggtcttgcttccagagcaacctgggcccaaaacatacttaccgcaatccaacaggtaagaagccttataggcaatgaagagtttctggactacatgccttcgatgaagagattcaggaaggaggaggagtcagagggagccatttggtaa

SEQ ID NO: 7716 - RNA, 9873 nt, synthetic construct
  misc_feature 1..9873: note = derived and/or modified CDS sequence (wt) from DENV-3__KC762685__SS-prME
  source 1..9873: mol_type = other RNA
acatcgctctgcctcatgatgatgttaccagcaacacttgctttccacctgacttcacgagatggagagccgcgcatgattgtggggaagaatgaaagagggaaatcccttctcttcaagacagcctctggaattaacatgtgcacactcatagccatggatttgggagagatgtgtgatgacacggtcacttacaaatgcccccttatcactgaagtggagcctgaggacattgactgctggtgcaacctcacatcgacgtgggtgacctacggaacgtgcaaccaagctggagagcatagacgcgataagagatcggtggcgttagctccccatgtcggcatgggactggacacacgcgcccaaacctggatgtcggctgaaggagcttggagacaagttgagaaggtagagacatgggcttttaggcacccagggttcacaatactagccctatttcttgcccattacataggcacttccttgacccagaaagtggtcattttcatactactgatgctggtcaccccatccatgacaatgagatgtgtgggagtaggaaacagagatttcgtggaaggcctatcaggagctacgtgggttgacgtggtgctcgagcacggtgggtgtgtgactaccatggctaagaacaagcccacgctagatatagagctccagaagaccgaggccactcaactggcgaccctaaggaaactatgtattgaggggaaaatcaccaacgtaacaaccgactcaaggtgccccacccaaggggaagcgattttacctgaggaacaggaccagaactacgtgtgtaagcacacatacgtggacagaggctgggggaacggttgtggtttgtttggcaagggaagcttggtaacatgcacgaagtttcaatgtttggaatttatagagggaaaagtggtgcagcatgagaacctcaaatacaccgtcatcatcacagtgcacacaggagaccaacatcaggtgggaaatgaaacgcagggagtcacggctgagataacacctcaggcatcaaccgtcgaagccatcttacctgaatatggaacccttgggctagaatgctcaccacggacaggtttggatttcaatgaaatgattttgttgacaatgaagaacaaagcatggatggtacatagacagtggtttttcgacctacctctaccatggacatcaggggccacaacagaaacaccaacctggaacaagaaagagcttcttgtgacatttaaaaatgcacacgcaaagaaacaagaagtagtagtccttggatcgcaagagggagcaatgcacacagcactgacaggagccacagagatccaaacctcaggaggcacaagtatttttgcggggcatttaaagtgcagactcaagatggacaaattggaactcaaggggatgagctatgcaatgtgcttaaatgcctttgtgttgaagaaagaagtctccgaaacacaacatgggacaatactcattaaggttgagtacaaaggggaagatgcaccttgcaagattcctttctccacggaggatggacagggaaaagcccacaatggcagactgatcacagctaacccagtggtgaccaagaaggaggagcctgtcaatattgaggcagaacctccttttggggaaagtaacatagtaattggaattggagacaaagctttgaaaatcaactggtacaagaagggaagctcgattgggaagatgttcgaggccactgccagaggtgcaaggcgcatggccatcttgggagacacagcctgggactttggatcagtaggtggtgttttaaattcattagggaaaatggtgcaccaaatatttggaagtgcttacacggccctatttagtggagtctcttggataatgaaaattggaataggcgtccttttaacctggatagggttgaattcaaaaaacacttctatgtcattttcatgcattgtgatagggatcatcacactctatctgggagccgtggtgcaagctgacatggggtgtgtcataaactggaaaggcaaagaactcaaatgtggaagcgggattttcgttaccaatgaggtccacacctggacagagcaatacaaatttcaagcagactcccctaagagactggcaacagccattgcaggcgcctgggaaaatggagtgtgcggaatcaggtcgacaaccagaatggagaaccttttgtggaagcaaatagccaatgaactgaactacatattatgggaaaacaacatcaaattgacggtagttgtgggtgatataattggggtcttagagcaagggaaaagaacactgacaccacaacccatggagctgaaatattcgtggaaaacatggggaaaggcgaaaatagtgacagctgagacacaaaattcctccttcataatagatgggccaaacacaccagagtgtccaagtgcctcaagagcatggaatgtgtgggaggtggaagattacgggttcggagtcttcacaactaatatatggctgaaacttcgagagatgtacacccaactatgtgaccacaggctaatgtcggcagccgttaaggatgagagagccgtacacgccgacatgggctattggatagaaagccaaaagaatggaagttggaaactagaaaaggcatccctcatagaggtgaaaacctgcacatggccaaaatcacacactctctggagcaatggcgtgctggagagtgacatgatcatcccaaagagtctggctggtcctgtttcgcaacacaactacaggcccggatatcacacccaaacggcaggaccttggcacctaggaaaattggagctggatttcaactattgtgaaggaacgacagttgtcatcacagaaaattgtgggacaagaggcccatcactgaggacaacaacagtgtcagggaagttgatacacgaatggtgttgccgctcatgtacacttcctcccctgcgatacatgggagaagacggctgttggtatggcatggaaattagacccattaatgagaaagaagagaacatggtaaagtctttagtctcagcagggagtggaaaggtggataacttcacaatgggtgttttatgtctggcaatcctctttgaagaggtgatgagaggaaaattcggaaaaaagcacatgattgcaggggttctctttacatttgtgctccttctctcagggcagataacatggagagatatggcgcgcacactcataatgattgggtccaacgcctctgacagaatgggaatgggcgtcacttacctagcattgattgcaacatttaaaattcagccatttttggctttgggattcttcctgaggaaactgacatctagagaaaatttattgttgggagttgggctggccatggcaacaacgttacaactgccagaggacattgaacaaatggcgaatggaatagctttggggctcatggctctcaaattgataacacaatttgaaacatatcaactatggacggcattagtttccctaatgtgttcaaacacaattttcacgttgactgttgcctggagaacagccaccctgattttggccggaatttcgcttttgccagtgtgccagtcttcgagcatgaggaaaacagattggctcccagttactgtggcagccatgggagttccacccctaccactgtttatcttcagtttgaaagatacgctcaaaaggagaagctggccactaaatgagggggtgatggccgttggacttgtgagcattctagcaagttctctccttaggaatgacgtacccatggctggaccattagtggctgggggcttgctgatagcgtgctacgttataactggcacgtcagcagacctcactgtagaaaaagcagcagatgtgatatgggaggaagaggctgagcagacaggagtgtcccacaatttaatgatcacagttgatgatgatggaacaatgagaataaaagatgatgagactgagaacatcctaacagtgctattgaaaacagcattactaatagtgtcaggcatttttccatactccatacccgctacactgttggtctggcacacttggcaaaagcaaacccaaagatccggcgtcctatgggacgttcccagccccccagagacacagaaagcagaactggaagaaggggtctataggattaagcagcaaggaatttttgggaagacccaagtgggggttggagtacaaaaagaaggagttttccacaccatgtggcacgtcacaagaggagcagtgctgacacacaacgggaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaacttccaaaccatgccaggcattttccagacaacaacaggagagataggagcgattgcactggactttaagcctgggacttcaggatctcccatcataaacagagagggaaaggtagtgggactgtatggcaatggagtggtcacaaagaatggtggctatgtcagtggaatagctcaaacaaacgcagaaccagacggaccgacaccagagttggaagaagagatgttcaagaagcggaatctaaccataatggatctccatcccgggtcaggaaagacgcggaaatacctcccagctattgttagagaagcaatcaaaagacgcttaaggactctaattttggcaccaacaagggtggtcgcagctgagatggaagaagcattgaaggggctcccaataaggtatcaaacaactgcaacaaaatctgcacacacagggaaagagattgttgatctaatgtgtcacgcaacatttacaatgcgtttactgtcaccagtcagagttccaaactataacttgataataatggatgaggctcattttacagacccagctagcatagcggctagagggtacatatcaactcgtgtaggaatgggagaggcagccgcaattttcatgacagccacgccccctggcacagctgatgcctttcctcagagcaatgccccaattcaagatgaagaaagagacataccagaacgctcatggaattcaggtaatgaatggattaccgactttgccgggaagacggtgtggtttgtccctagcatcaaagctggaaatgacatagcaaactgcttgcggaaaaatggaaaaaaggtcattcaacttagtaggaagacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagcgccgcgcaaaggagagggagagttggcaggaacccacaaaaggaaaatgaccaatacatattcacgggccagcccctcaataatgatgaagaccacgctcactggacagaagcaaaaatgctgctagacaacatcaacacaccagaagggattataccagctctctttgaaccagaaagggagaagtcagccgccatagacggcgaataccgcctgaaaggtgaatccaggaagaccttcgtggaactcatgaggaggggtgacctcccagtttggctagcccataaagtagcatcagaaggaatcaaatatacagacagaaaatggtgctttgatggagaacgcaacaaccaaattttagaagaaaatatggatgtggaaatctggacaaaggaaggagaaaagaaaaaattgaggcctaggtggcttgatgcccgcacctattcagatcccttagcgctcaaggaattcaaggactttgcggctggtagaaagtcgatcgctcttgatcttgtgacagaaataggaagagtgccttcacacctagcccacagaacgagaaacgctctggacaatctggtgatgttgcacacgtcagaacatggtgggagggcttacaggcatgccgtggaggaattaccagaaacaatggaaacactcttactcctgggactcatgatcctgttaacaggtggggcaatgcttttcttgatatcaggtaaagggattggaaagacttcaataggactcatttgtgtggttgcttccagcggtatgttatggatggctgatgtcccactccaatggatcgcgtcggccatagtcctggagttttttatgatggtgctacttataccagaaccagaaaagcagagaactccccaagacaatcaactcgcatatgttgtgataggcatactcacattggctgcaatagtggcagccaatgaaatgggattgttggaaaccacaaagagagatttaggaatgtccaaagaaccaggtgttgtttctccaactagctatttggatgtggatttgcacccagcatcagcctggacattgtacgctgtggccacaacagtaataacaccaatgttgagacacaccatagagaattccacagcaaatgtgtccctggcagctatagccaaccaggcagtggtcctgatgggtttagacaaaggatggccgatatcgaaaatggacttaggcgtaccactattggcactgggttgctattcgcaagtgaacccactaactctcacagcggcagtactcctgctagtcacgcattacgccattataggtccaggattgcaggcaaaagccactcgtgaagcccaaaaaaggacagctgctggaataatgaagaatccaacggtggatgggataatgacaatagacctagatcctgtaatatacgattcaaaatttgaaaagcaactaggacaggttatgctcctggttctgtgtgcagttcaacttttgttaatgagaacatcctgggcattttgtgaagctctaaccctagccacaggaccaataacaacactctgggaagggtcacctgggaagttctggaacaccacgatagctgtttccatggcgaacatctttagagggagctatttagcaggagctgggcttgctttttctatcatgaaatcagttggaacaggaaagagaggaacagggtcacaaggtgaaaccttgggagaaaagtggaaaaagaaattgaatcaattatctcggaaagaatttgacctttacaagaaatccggaatcactgaagtggatagaacagaagccaaagaagggttgaaaagaggagaaataacacaccatgccgtatccagaggcagcgcgaaacttcaatggttcgtggagagaaacatggtcatccctgaaggaagagtcatagacttgggctgtggaagaggaggctggtcatattattgtgcaggactgaaaaaagttacagaagtgcgaggatacacaaaaggcggcccaggacatgaagaaccagtacctatgtctacatacggatggaacatagtcaagctaatgagtggaaaggatgtgttttatcttccacctgaaaagtgtgacactctattgtgtgacattggagaatcttcaccaagcccaacagtggaagaaagcagaaccataagagtcttgaagatggttgaaccatggctaaaaaataaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcacagttcaacatggcactatgatgaagaaaatccttataaaacgtgggcttaccatggatcctatgaagttaaggccacaggctcagcctcctccatgataaatggagttgtgaaactcctcacgaaaccatgggatgtggtgcccacggtgacacagatggcaatgacggatacaacccctttcggccagcaaagggttttcaaagagaaagtggacactaggacacctagacccatgccaggaacaagaaaggctatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgcgtctacaacatgatgggcaagagagagaagaaactcggagagtttggcaaagcaaaaggcagtagagccatatggtacatgtggttgggagctaggtaccttgagttcgaggcgctcggattcttaaatgaagaccattggttctcgcgtgaaaactctttcagtggagtagaaggggaaggactgcataaactgggatacatcttgagagacatttccaagataccaggaggagctatgtatgctgatgacacagctggttgggacacaagaataacagaagatgacctgcataacgaggaaaaaatcacgcagcaaatggagcctgaacacaggcaattagcaaacgccatatttaagctcacataccaaaacaaagtggtcaaggttcaacgaccaactccaaagggcacggtgatggacatcatatctaggaaagaccaaagaggcagcggacaggtgggaacttatggtctgaatacatttaccaacatggaagttcagttaatcagacaaatggaaggagaaggtgtgctgtcgaaggcagacctcgagaaccctcatctgctagagaaggaaattacacaatggttggaaactaaaggagtggagaggttaaaaagaatggccatcagcggggatgattgcgtggtgaaaccaatcgatgacaggttcgccgatgccctgcttgccctgaatgacatggggaaagttaggaaggacatacctcaatggcagccatcgaagggatggcatgattggcaacaggttcctttctgctcccaccactttcatgaattgatcatgaaagatggaagaaagttggtagtcccctgcagacctcaggatgaattaatagggagagcgagaatttctcaaggagcaggatggagccttaaagaaactgcatgcctggggaaagcctacgcccaaatgtgggctctcatgtattttcacagaagagatctcagactagcatccaacgccatatgttcagcagtacctgtccactgggtccccacaagcaggacgacgtggtccattcatgctcaccatcagtggatgaccacagaggacatgcttactgtttggaacagggtgtggatagaggacaatccatggatggaagataaaactccagtcacaacttgggaagatgttccatacctagggaagagagaagaccaatggtgcggatcactcattggtcttgcttccagagcaacctgggcccaaaacatacttaccgcaatccaacaggtaagaagccttataggcaatgaagagtttctggactacatgccttcgatgaagagattcaggaaggaggaggagtcagagggagccatttggtaa

SEQ ID NO: 7717 - RNA, 9873 nt, synthetic construct
  misc_feature 1..9873: note = derived and/or modified CDS sequence (wt) from DENV-3__KC762687__SS-prME
  source 1..9873: mol_type = other RNA
acatcgctctgtctcatgatgatgttaccagcaacacttgctttccacttgacttcacgagatggagagccgcgcatgattgtggggaagaatgaaagagggaaatcccttctcttcaagacagcctctggaattaatatgtgcacactcatagccatggatttgggagagatgtgtgacgacacggtcacttacaaatgcccccttatcactgaagtggagcctgaagacattgactgctggtgcaacctcacatcgacgtgggtgacctacggaacgtgcaaccaagctggagagcatagacgcgataagagatcggtggcgttagctccccatgtcggcatgggactggacacacgcgcccaaacctggatgtcggctgaaggagcttggagacaagttgagaaggtagagacatgggcttttaggcacccagggttcacaatactagccctatttcttgcccattacataggcacttccttgacccagaaagtggtcattttcatactactgatgctggtcaccccatccatgacaatgagatgtgtgggagtaggaaacagagatttcgtggaaggcctatcaggagctacgtgggttgacgtggtgctcgagcacggtgggtgtgtgactaccatggctaagaacaagcccacgctagatatagagctccagaagaccgaggccacccaactggcgaccctaaggaaactatgtattgaggggaaaatcaccaacgtaacaaccgactcaaggtgccccactcaaggggaagcgattttacctgaggaacaggaccagaactatgtgtgcaagcacacatacgtggacagaggctggggaaacggttgtggtttgtttggcaagggaagcttggtaacatgcgcgaagtttcaatgtttggaatttatagagggaaaagtggtacagcatgagaacctcaaatacaccgtcatcatcacagtgcacacaggagaccaacatcaggtgggaaatgaaacgcagggagtcacggctgagataacacctcaggcatcaaccgtcgaagccatcttacctgaatatggtacccttgggctagaatgctcaccacggacaggtttggatttcaatgaaatgattttgttgacaatgaagaacaaagcatggatggtacatagacagtggttttttgacctacctctaccatggacatcaggggccacaacagaaacaccaacctggaacaagaaagaacttcttgtgacatttaaaaatgcacacgcaaaaaaacaagaagtagtagtccttggatcgcaagagggagcaatgcacacagcactgacaggagctacagagatccaaacctcaggaggcacaagtatttttgcggggcacttaaagtgcagactcaagatggacaaattggaacttaaggggatgagctatgcaatgtgcttaaatgcctttgtgttgaagaaggaagtctccgaaacacaacatgggacaatactcattaaggttgagtacaaaggggaagatgcaccttgcaagattcctttctccacggaggatggacaagggaaagcccacaatggcagactgatcacagctaacccagtggtggtcaagaaggaggagcctgtcaatattgaagcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgtattaaattcattagggaaaatggtgcaccaaatatttggaagtgcttacacggccttatttagtggagtctcctggataatgaaaattggaataggcgtccttttaacctggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagtgggattttcgttaccaatgaggtccacacctggacagagcaatacaaatttcaagcagactcccctaagagactggcaacagccattgcaggcgcctgggaaaatggagtgtgcggaatcaggtcgacaaccagaatggagaaccttttatggaagcaaatagccaatgaactgaactacatattatgggaaaacaacatcaaattgacggtggttgtgggtgatataattggggtcttagagcaagggaaaagaacactgacaccacaacccatggagctaaaatattcgtggaaaacatggggaaaggcgaaaatagtgacagctgagacacaaaattcctccttcataatagatgggccaaacacaccagagtgtccaagtgcctcaagagcatggaatgtgtgggaggtggaagattacgggttcggagtcttcacaactaatatatggctgaaactccgagagatgtacacccaactatgtgaccacaggctaatgtcggcagccgttaaggatgagagagccgtacacgccgacatgggctattggatagaaagccaaaagaatggaagttggaaactagaaaaggcatccctcatagaggtgaaaacctgcacatggccaaaatcacacactctctggagcaatggcgtgctagagagtgacatgatcatcccaaagagtctggctggtcctgtttcgcaacacaactacaggcccggatatcacacccaaacggcaggaccttggcacctaggaaaattggagctggatttcaactattgtgaaggaacaacagttgtcatcacagaaaattgtgggacaagaggcccatcactgaggacaacaacagtgtcagggaagttgatacacgaatggtgttgccgctcgtgcacacttcctcccctgcgatacatgggagaagacggctgttggtatggcatggaaattagacccattaatgagaaagaagagaacatggtaaagtctctagtctcagcagggagtggaaaggtggataacttcacaatgggtgttttatgtttggcaatcctctttgaagaggtgatgagaggaaaatttggaaaaaagcacatgatcgcaggggttctctttacatttgtgctccttctctcagggcagataacatggagagacatggcgcgcacactcataatgattgggtccaacgcctctgacagaatgggaatgggcgtcacttacctagcattgattgcaacatttaaaattcagccatttttggctttgggattcttcctgaggaaactgacatccagagaaaatttattgttgggagttgggctggccatggcaacaacgttacaactgccagaggacattgaacaaatggcgaatggaatagctttggggctcatggctctcaaattgataacacaatttgaaacataccaactatggacggcattagtctccctaatgtgttcaaacacaattttcacattgactgttgcctggagaacagccaccctgattttggccggaatctcgctttttccagtgtgccagtcttcgagcatgaggaaaacagattggctcccagtgactgtggcagctatgggagttccacccctaccactgtttatcttcagtttgaaagatacgctcaaaaggagaagctggccactaaatgagggggtgatggccgttggacttgtgagcattctagcaagttctctccttaggaatgacgtacccatggctggaccactagtggctgggggcttgctgatagcgtgctacgtcataactggcacgtcagcagatctcactgtagaaaaagcagcagatgtgatatgggaggaagaggctgagcaaacaggagtgtcccataatttaatgatcacagttgatgatgatggaacaatgagaataaaagatgatgagactgagaacatcctaacagtgctattgaaaacagcattactaatagtgtcaggcatttttccatactccatacccgcaacactgttggtctggcacacttggcaaaagcaaacccaaagatccggcgtcctatgggacgtacccagccccccagagacacagaaagcagaactggaagaaggggtctataggattaagcagcaaggaatttttggaaagacccaagtgggggttggagtacaaaaagaaggagttttccacaccatgtggcacgtcacaagaggagcagtgctgacacacaatgggaaaagactggaaccaaactgggctagtgtgaaaaaagatctgatttcatacggaggaggatggagattgagtgcacaatggcaaaaaggagaagaggtgcaggttattgccgtagagcctgggaagaacccaaagaacttccaaaccatgccaggcactttccagacaacaacaggggagataggagcgattgcactggacttcaagcctgggacttcaggatctcccatcataaacagagagggaaaggtagtgggactgtatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctattgttagagaagcaatcaaaagacgcttaaggactttaattttggcaccaacaagggtggttgcagctgagatggaagaagcattgaaagggcttccaataaggtatcaaacaactgcaacaaaatctgtacacacagggaaagagattgttgatctaatgtgtcacgcaacattcacaatgcgtttgctgtcaccagtcagagttccaaactataacttgataataatggatgaggctcatttcacagacccagctagcatagcggctagagggtacatatcaactcgtgtaggaatgggagaggcagccgcaattttcatgacagccacgccccctggcacagctgatgcctttcctcagagcaatgccccaatccaagatgaagaaagagacataccagaacgctcatggaattcaggtaatgaatggattaccgactttgccgggaagacggtgtggtttgtccctagcatcaaagctggaaatgacatagcaaactgcttgaggaaaaatggaaaaaaggtcattcaacttagtaggaagacttttgacacagaatatcaaaagactaaactaaatgattgggactttgtggtgacaacagacatttcagaaatgggagccaatttcaaagcagacagagtgatcgacccaagaaggtgtctcaagccagtcattttgacagacggacccgagcgcgtgatcctggcgggaccaatgccagtcaccgtagcaagcgccgcgcaaaggagagggagagttggcaggaacccgcaaaaggaaaatgaccaatacatattcacgggccagcccctcaataatgatgaagaccacgctcactggacagaagcaaaaatgctgctagacaacatcaacacaccagaagggattataccagctctctttgaaccagaaagggagaagtcagccgccatagacggcgaataccgcctgaaaggtgaatccaggaagaccttcgtggaactcatgaggaggggtgacctcccagtttggctagcccataaagtagcatcagaaggaatcaaatatacagacagaaaatggtgttttgatggagaacgcaacaaccaaattttagaagaaaatatggatgtggaaatctggacaaaggaaggagaaaagaaaaaattgaggcctaggtggcttgatgcccgcacctattcagatcccttagcgctcaaggaattcaaggactttgcggctggtagaaagtcgatcgctcttgatcttgtgacagaaataggaagagtgccttcacacctagcccacaaaacgagaagcgctctggacaatctggtgatgttgcacacgtcagaacatggtgggagggcttacaggcatgcagtggaggaattaccagaaacaatggaaacactcttactcctgggactcatgatcctgttaacaggtggggcaatgcttttcctgatatcaggtaaagggattggaaagacctcaataggactcatctgtgtagttgcttccagcggcatgttatggatggctgatgtcccactccaatggatcgcgtcggccatagtcctggagttttttatgatggtgctacttataccagaaccagaaaagcagagaactccccaagacaatcaactcgcatatgttgtgataggcatactcacactggctgcaatagtggcagccaatgaaatgggattgttggaaaccacaaagagagatttaggaatgtccaaagaaccaggtgttgtttctccaaccagctatttggatgtggatttgcacccagcatcagcctggacattgtacgctgtggccacaacagtaataacaccaatgttgagacacaccatagagaattccacagcaaatgtgtccctggcagctatagccaaccaggcagtggtcctgatgggtttagacaaaggatggccgatatcgaaaatggacttaggtgtaccactattggcactgggttgctattcgcaagtgaacccactaactcttacagcggcagtactcctgctagtcacgcattatgccattataggtccaggattgcaggcaaaagccactcgtgaagcccaaaaaaggacagctgctggaataatgaagaatccaacggtggatgggataatgacaatagacctagatccagtaatatacgattcaaaatttgaaaagcaactaggacaggttatgctcctggttctgtgtgcagttcaacttttgttaatgagaacatcatgggcattttgtgaagctctaaccctagccacaggaccaataacaacactctgggaagggtcacctgggaagttctggaacaccacgatagctgtttccatggcgaacatctttagaggaagctatttagcaggagctgggcttgctttttctatcatgaaatcagttggaacaggaaagagaggaacagggtcacaaggtgaaaccttgggagaaaagtggaaaaagaaattgaatcaattatctcggaaagagtttgacctttacaagaaatccggaatcactgaagtggatagaacagaagccaaagaagggttgaaaagaggagaaataacacaccatgccgtatccagaggcagcgcgaaacttcaatggttcgtggagagaaacatggtcatccctgaaggaagagtcatagacttgggctgtggaagaggaggctggtcatattattgtgcaggactgaaaaaagttacagaagtgcgaggatacacaaaaggcggcccaggacatgaagaaccagtacctatgtctacatacggatggaacatagtcaagctaatgagtggaaaggatgtgttttatcttccacctgaaaagtgtgacactctattgtgtgacattggagaatcttcaccaagcccaacagtggaagaaagcagaaccataagagtcttgaagatggttgaaccatggctaaaaaacaaccagttttgcattaaagtattgaacccttacatgccaactgtgattgagcacctagaaagactacaaaggaaacatggaggaatgcttgtgagaaatccactctcacgaaactccacacacgaaatgtactggatatctaatggcacaggcaacatcgtctcttcagtcaacatggtatccagactgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcacagttcaacatggcactatgatgaagaaaatccttataaaacgtgggcttaccatggatcctatgaagtcaaggccacaggctcagcctcctccatgataaatggagttgtgaaactcctcacgaaaccatgggatgtggtgcccacggtgacacagatggcaatgacggatacaacccctttcggccagcaaagggttttcaaagagaaagtggacaccaggacacctagacccatgccaggaacaagaaaggctatggagatcacagcggaatggctttggagaaccctaggaaggaacaaaagacccagattatgcacgagagaagagttcacaaaaaaggtcagaaccaacgcagctatgggcgccgtattcacagaggagaaccaatgggacagtgctaaagctgccgttgaagatgaagaattctggaaactcgtggacagagaacgtgaactccacaaattgggcaagtgtggaagctgcgtctacaacatgatgggcaagagagagaagaaactcggagagtttggcaaagcaaaaggcagtagagccatatggtacatgtggttgggagctaggtaccttgagttcgaggcgctcggattcttaaatgaagaccattggttctcgcgtgaaaactctttcagtggagtagaaggggaaggactgcataaactgggatacatcttgagagacatttccaagatacccggaggagctatgtatgctgatgacacagctggttgggacacaagaataacagaagatgacctgcacaatgaggaaaaaatcacgcagcaaatggaccctgaacacaggcaattagcaaacgccatatttaagcttacataccaaaacaaagtggtcaaggttcaacgaccaactccaaagggcacggtgatggacatcatatctaggaaagaccaaagaggcagtggacaggtgggaacttatggtctgaatacattcaccaacatggaagttcagttaatcagacaaatggaaggagaaggtgtgctgtcgaaggcagacctcgagaaccctcatctgctagagaaggaaattacacaatggttggaaactaaaggagtggagaggttgaaaagaatggccatcagcggggatgattgcgtggtgaaaccaatcgatgacaggttcgccgatgccctgcttgccctgaatgacatggggaaagttaggaaggacatacctcaatggcagccatcgaagggatggcatgattggcaacaggttcctttctgctcccaccactttcatgaattgatcatgaaagatggaagaaagttggtagtcccctgcagacctcaggatgaattaatagggagagcgagaatctctcaaggagctggatggagccttagagaaactgcatgcctggggaaagcctacgcccaaatgtgggctctcatgtattttcacagaagagatctcagactagcatccaacgccatatgttcagcagtacctgtccactgggtccccacaagcaggacgacgtggtccattcatgctcaccaccagtggatgaccacagaggacatgctaactgtttggaacagggtgtggatagaggataatccatggatggaagataaaactccagtcacaacttgggaagatgttccatatctagggaagagagaagaccaatggtgcggatcactcattggtcttgcttccagagcaacctgggcccaaaacatacttaccgcaatccagcaggtaagaagccttataggcaatgaagagtttctggactacatgccttcgatgaagagattcaggaaggaggaggagtcagagggagccatttggtag

SEQ ID NO: 7718 - RNA, 9873 nt, synthetic construct
  misc_feature 1..9873: note = derived and/or modified CDS sequence (wt) from DENV-3__KC762688__SS-prME
  source 1..9873: mol_type = other RNA
acatcgctctgcctcatgatgatgttaccagcaacacttgctttccacttgacctcacgagatggagagccgcgcatgattgtggggaagaatgaaagagggaaatcccttctcttcaagacagcctctggaattaatatgtgcacactcatagccatggatttgggagagatgtgtgatgacacggtcacttacaaatgcccccttatcactgaagtggagcctgaggacattgactgctggtgcaacctcacatcgacgtgggtgacctacggaacgtgcaaccaagctggagagcatagacgcgataagagatcggtggcgttagctccccatgtcggcatgggactggacacacgcgcccaaacctggatgtcggctgaaggagcttggagacaagttgagaaggtagagacatgggcttttaggcacccagggttcacaatactagccctatttcttgcccattacataggcacttccttgacccagaaagtggtcattttcatactactgatgctggtcaccccatccatgacaatgagatgtgtgggagtaggaaacagagatttcgtggaaggcctatcaggagctacgtgggttgacgtggtgctcgagcacggtgggtgtgtgactaccatggctaagaacaagcccacgctagatatagagctccagaagaccgaggccacccaactggcgaccctaaggaaactatgtattgaggggaaaatcaccaacgtaacaaccgactcaaggtgccccacccaaggggaagcgattttacctgaggaacaggaccagaactacgtgtgtaagcacacatacgtggacagaggctgggggaacggttgtggtttgtttggcaagggaagcttggtaacatgcgcgaagtttcaatgtttggaatttatagagggaaaagtggtgcagcatgagaacctcaaatacaccgtcatcatcacagtgcacacaggagaccaacatcaggtgggaaatgaaacgcagggagtcacggctgagataacacctcaggcatcaaccgtcgaagccatcttacctgaatatggaacccttgggctagaatgctcaccacggacaggtttggatttcaatgaaatgattttgttgacaatgaagaacaaagcatggatggtacatagacagtggttttttgacctacctctaccatggacatcaggggccacaacagaaacaccaacctggaacaagaaagagcttcttgtgacatttaaaaatgcacacgcaaagaaacaagaagtagtagtccttggatcgcaagagggagcaatgcacacagcactgacaggagccacagagatccaaacctcaggaggcacaagtatttttgcggggcatttaaagtgcagactcaagatggacaaattggaactcaaggggatgagctatgcaatgtgcttaaatgcctttgtgttgaagaaagaagtctccgaaacacaacatgggacaatactcattaaggttgagtacaaaggggaagatgcaccttgcaagattcctttctccacggaagatggacagggaaaagcccacaatggcagactgatcacagctaatccagtggtgaccaagaaggaggagcctgtcaatattgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattagggaaaatggtgcaccaaatatttggaagtgcttacacggccctatttagtggagtctcctggataatgaaaattggaataggcgtccttttaacctggatagggttgaattcaaaaaacacttctatgtcattttcatgcattgtgataggaatcatcacactctatctgggagccgtggtgcaagctgacatggggtgtgttataaactggaaaggcaaagaactcaaatgtggaagcgggattttcgttaccaatgaggtccacacctggacagagcaatacaaatttcaagcagactcccctaagagactggcaacagccattgcaggcgcctgggaaaatggagtgtgcggaatcaggtcgacaaccagaatggagaaccttttgtggaagcaaatagccaatgaactgaactacatattatgggaaaacaacatcaaattgacggtagttgtgggtgacataattggggtcttagagcaagggaaaagaacactgacaccacaacccatggagctaaaatattcgtggaaaacatggggaaaggcgaaaatagtgacagctgagacacaaaattcctccttcataatagatgggccaaacacaccagagtgtccaagtgcctcaagagcatggaatgtgtgggaggtggaagattacgggttcggagtcttcacaactaatatatggctgaaactccgagagatgtacacccaactatgtgaccacaggctaatgtcggcagccgttaaggatgagagagccgtacacgccgacatgggctattggatagaaagccaaaagaatggaagttggaaactagaaaaggcatccctcatagaggtgaaaacctgcacatggccaaaatcacacactctctggagcaatggcgtgctggagagtgacatgatcatcccaaagagtctggctggtcctgtttcgcaacacaactacaggcccggatatcacacccaaacggcaggaccttggcacctaggaaaattggagctggatttcaactattgtgaagggacaacagttgtcatcacagaaaattgtgggacaagaggcccatcactgaggacaacaacagtgtcagggaagttgatacacgaatggtgttgccgctcatgtacacttcctcccctgcgatacatgggagaagacggctgttggtatggcatggaaattagacccattaatgagaaagaagagaacatggtaaagtctttagtctcagcagggagtggaaaggtggataacttcacaatgggtgttttatgtttggcaatcctctttgaagaagtgatgagaggaaaattcggaaaaaagcacatgattgcaggggttctctttacttttgtgctccttctctcagggcagataacatggagagatatggcgcgcacactcataatgattgggtccaacgcctctgacagaatgggaatgggcgtcacttacctagcattgattgcaacatttaaaattcagccatttttggctttgggattcttcctgaggaagctgacatctagagaaaatttattgttgggagttgggctggccatggcaacaacgttacaactgccagaggacattgaacaaatggcgaatggaatagctttggggctcatggctctcaaattgataacacaatttgaaacatatcaactatggacggcattagtttccctaatgtgttcaaacacacttttcacgttgactgttgcctggagaacagccaccctgattttggccggaatttcgcttttgccagtgtgccagtcttcgagcatgaggaaaacagattggctcccagttactgtggcagccatgggagttccacccctaccactgtttatcttcagtttgaaagatacgctcaaaaggagaagctggccactaaatgagggggtgatggccgttggacttgtgagcattctagcaagttctctccttaggaatgacgtacccatggctggaccattagtggctgggggcttgctgatagcgtgctacgttataactggcacgtcagcagacctcactgtagaaaaagcagcagatgtgatatgggaggaagaggctgagcaaacaggagtgtcccacaatttaatgatcacagttgatgatgatggaacaatgagaataaaagatgatgagactgagaacatcctaacagtgctactgaaaacagcattactaatagtgtcaggcatttttccatactccatacccgctacactgttggtctggcacacttggcaaaagcaaacccaaagatccggcgtcctatgggacgtacccagccccccagagacacagaaagcagaactggaagaaggggtctataggattaagcagcaaggaatttttgggaagacccaagtgggggttggagtacaaaaagaaggagttttccacaccatgtggcacgtcacaagaggagcagtgctgacacacaacgggaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaacttccaaaccatgccaggcattttccagacaacaacaggagagataggagcgattgcactggactttaagcctgggacttcaggatctcccatcataaacagagagggaaaggtagtgggactgtatggcaatggagtggtcacaaagaatggtggctatgtcagtggaatagctcaaacaaacgcagaaccagacggaccgacaccagagttggaagaagagatgttcaagaagcgaaatctaaccataatggatctccatcccgggtcaggaaagacgcggaaatacctcccagctattgttagagaagcaatcaaaagacgcttaaggactctaattttggcaccaacaagggtggtcgcagctgagatggaagaagcattgaaagggctcccaataaggtatcaaacaactgcaacaaaatctgcacacacagggaaagagattgttgatctaatgtgtcacgcaacattcacaatgcgtttactgtcaccagtcagagttccaaactataacttgataataatggatgaggctcattttacagacccagctagcatagcggctagagggtacatatcaactcgtgtaggaatgggagaggcagccgcaattttcatgacagccacgccccctggcacagctgatgcctttcctcagagcaatgccccaattcaagatgaagaaagagacataccagaacgctcatggaattcaggtaatgaatggattaccgactttgccgggaagacggtgtggtttgtccctagcatcaaagctggaaatgacatagcaaactgcttgcggaaaaatggaaaaaaggtcattcaacttagtaggaagacttttgacacagaatatcaaaagaccaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagcgccgcgcaaaggagagggagagttggcaggaacccacaaaaggaaaatgaccaatacatattcacgggccagcccctcaataatgatgaagaccacgctcactggacagaagcaaaaatgctgctagacaacatcaacacaccagaagggatcataccagctctctttgaaccagaaagggagaagtcagccgccatagacggcgaataccgcctgaaaggtgaatccaggaagaccttcgtggaactcatgaggaggggtgacctcccagtttggctagcccataaagtagcatcagaaggaatcaaatatacagacagaaaatggtgctttgatggagaacgcaacaaccaaattttagaagaaaatatggatgtggaaatctggacaaaggaaggagaaaagaaaaaattgaggcctaggtggcttgatgcccgcacctattcagatcccttagcgctcaaggaattcaaggactttgcggctggtagaaagtcgatcgctcttgatcttgtgacagaaataggaagagtgccttcacacctagcccacagaacgagaaacgctctggacaatctggtgatgttgcacacgtcagaacatggtgggagggcttacaggcatgcagtggaggaatttccagaaacaatggaaacactcttactcctgggactcatgatcctgttaacaggtggggcaatgcttttcttgatatcaggtaaaggaattggaaagacttcaataggactcatttgtgtagttgcttccagcggtatgttatggatggctgatgtcccactccaatggatcgcgtcggccatagtcctggagttttttatgatggtgctacttataccagaaccagaaaagcagagaactccccaagacaatcaactcgcatatgttgtgataggcatactcacattggctgcaatagtggcagccaatgaaatgggattgttggaaaccacaaagagagatttaggaatgtccaaagaaccaggtgttgtttctccaactagctatttggatgtggatttgcacccagcatcagcctggacattgtacgctgtggccacaacggtaataacaccaatgttgagacacaccatagagaattccacagcaaatgtgtccctggcagccatagccaaccaggcagtggtcctgatgggtttagacaaaggatggccgatatcgaaaatggacttaggcgtaccactattggcactgggctgctattcgcaagtgaacccactaactctcacagcggcagtactcctgctagtcacgcattacgccattataggtccaggattgcaggcaaaagccactcgtgaagcccaaaaaaggacagctgctggaataatgaagaatccaacggtagatgggataatgacaatagacctagatcctgtaatatacgattcaaaatttgaaaagcaactaggacaggttatgctcctggttctgtgtgcagttcaacttttgttaatgagaacatcctgggcattttgtgaagctctaaccctagccacaggaccaataacaacactctgggaagggtcacctgggaagttctggaacaccacgatagctgtttccatggcgaacatctttagagggagctatttagcaggagctgggcttgctttttctatcatgaaatcagttggaacaggaaagagaggaacggggtcacaaggtgaaaccttgggagaaaagtggaaaaagaaattgaatcaattatctcggaaagaatttgacctttacaagaaatccggaatcactgaagtggatagaacagaagccaaagaagggttgaaaaaaggagaaataacacaccatgccgtatccagaggcagcgcgaaacttcaatggttcgtggagagaaacatggtcatccctgaaggaagagtcatagacttgggctgtggaagaggaggctggtcatattattgtgcaggactgaaaaaagttacagaagtgcgaggatacacaaaaggcggcccaggacatgaagaaccagtacctatgtctacatacggatggaacatagtcaagctaatgagtggaaaggatgtgttttatcttccacctgaaaagtgtgacactctattgtgtgacattggagaatcttcaccaagcccaacagtggaagaaagcagaaccataagagtcttgaagatggttgaaccatggctaaaaaataaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcacagttcaacatggcactatgatgaagaaaatccttataaaacgtgggcttaccatggatcctatgaagttaaggccacaggctcagcctcctccatgataaatggagttgtgaaactcctcacgaaaccatgggatgtggtgcccacggtgacacagatggcaatgacggatacaacccctttcggccagcaaagggttttcaaagagaaagtggacaccaggacacctagacccatgccaggaacaagaaaggctatggagatcacagcggaatggctttggagaaccctgggaaggaacaaaagacccagattatgcacgagagaggagttcacaaaaaaggtcagaaccaacgcagctatgggcgcagtattcacagaggagaaccaatgggacagtgctagagctgccgttgaagatgaagaattctggaaactcgtggacagagaacgtgaactccacaaactgggcaagtgtggaagctgcgtctacaacatgatgggcaagagagagaagaaactcggagagtttggcaaagcaaaaggcagtagagccatatggtacatgtggttgggagctaggtaccttgagttcgaggcgctcggattcttaaatgaagaccattggttctcacgtgaaaactctttcagtggagtagaaggggaaggactgcataaactgggatacatcttgagagacatttccaagatacccggaggagctatgtatgctgatgacacagctggttgggacacaagaataacagaagatgacctgcataacgaggaaaaaatcacgcagcaaatggaccctgaacacaggcaattagcaaacgccatatttaagctcacataccaaaacaaagtggtcaaggttcaacgaccaactccaaagggcacggtgatggacatcatatctaggaaagaccaaagaggcagcggacaggtgggaacttatggtctgaatacattcaccaacatggaagttcagttaatcagacaaatggaaggagaaggtgtgctgtcgaaggcagacctcgagaaccctcatctgctagagaaggaaattacacaatggttggaaactaaaggagtggagaggttaaaaagaatggccatcagcggggatgattgcgtggtgaaaccaatcgatgacaggttcgccgatgccctgcttgccctgaatgacatggggaaagttaggaaggacatacctcaatggcagccatcgaagggatggcatgattggcaacaggttcctttctgctcccaccactttcatgaattgatcatgaaagatggaagaaagttggtagtcccctgcagacctcaggatgaattaatagggagagcgagaatttctcaaggagcaggatggagccttaaagaaactgcatgcctggggaaagcctacgcccaaatgtgggctctcatgtattttcacagaagagatctcagactagcatccaacgccatatgttcagcagtacctgtccactgggtccccacaagcaggacgacgtggtccattcatgctcaccatcagtggatgaccacagaggacatgcttactgtttggaacagggtgtggatagaggacaatccatggatagaagataaaactccagtcacaacttgggaagatgttccatatctagggaagagagaagaccaatggtgcggatcactcattggtcttgcttccagagcaacctgggcccaaaacatacttaccgcaatccaacaggtaagaagccttataggcaatgaagagtttctggactacatgccttcgatgaagagattcaggaaggaggaggagtcagagggagccatttggtaa

SEQ ID NO: 7719 - RNA, 9873 nt, synthetic construct
  misc_feature 1..9873: note = derived and/or modified CDS sequence (wt) from DENV-3__KC762689__SS-prME
  source 1..9873: mol_type = other RNA
acatcgctctgcctcatgatgatgataccagcaacacttgctttccacttgacttcacgagatggagagccgcgcatgattgtggggaagaatgaaagagggaaatcccttcttttcaagacagcctctggaattaatatgtgcacactcatagccatggatttgggagagatgtgtgatgacacggtcacttacaaatgcccccttatcactgaagtggagcctgaagacattgactgttggtgcaacctcacatcgacgtgggtgacctacggaacgtgtaaccaagctggagagcatagacgcgataagagatcggtggcgttagctccccatgtcggcatgggactggacacacgcgcccaaacctggatgtcggctgaaggagcttggagacaagttgagaaggtagagacatgggcttttaggcacccagggttcacaatactagccctatttcttgcccattacataggcacttccttgacccagaaagtggtcatcttcatactactgatgctggtcaccccatccatgacaatgagatgtgtgggggtaggaaacagagatttcgtggaaggcctatcaggagctacgtgggttgacgtggtgctcgagcacggtgggtgtgtgactaccatggctaagaacaagcccacgctagatatagagctccagaagaccgaggccacccaactggcgaccctaaggaaactatgcattgaggggaaaatcaccaacgtaacaaccgactcaaggtgccccacccaaggggaagcgattttacctgaggaacaggaccagaactacgtgtgtaagcacacatacgtggacagaggctggggaaacggttgtggtttgtttggcaagggaagcttggtaacatgcgcgaagtttcaatgtttagaatttatagagggaaaagtggtgcagcatgagaacctcaaatacaccgtcatcatcacagtgcacacaggagaccaacatcaggtgggaaatgaaacgcagggagtcacggctgagataacacctcaggcatcaactgtcgaagccatcttacctgaatatggaacccttgggctagagtgctccccacggacaggtttggatttcaatgaaatgattttgttgacaatgaagaacaaagcatggatggtacatagacagtggttttttgacctacccctaccatggacatcaggggccacaacagaaacaccaacctggaacaagaaagagcttcttgtgacatttaaaaatgcacacgcaaaaaaacaagaagtagtagtccttggatcgcaagagggagcaatgcacacagcactgacaggagctacagagatccaaacctcaggaggcacaagtatttttgcggggcacttaaagtgcagactcaagatggacaaattggaactcaaagggatgagctatgcaatgtgcttaaatgcctttgtgttgaagaaagaagtctccgaaacacaacatgggacaatactcattaaggttgagtacaaaggggaagatgcaccttgcaagattcctttctccacggaggatggacaagggaaagcccacaatggcagactgatcacagctaacccagtggtgaccaagaaggaggagcctgtcaatattgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattagggaaaatggtgcaccaaatatttggaagtgcttacacggccctatttagtggagtctcctggataatgaaaattggaataggcgtccttctaacctggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagtgggattttcgttaccaatgaggtccacacctggacagagcaatacaaatttcaagcagactcccctaagagactggcaacagccattgcaggcgcctgggaaaatggagtgtgcggaatcaggtcgacaaccagaatggagaaccttttgtggaagcaaatagccaatgaactgaactacatactatgggaaaacaacattaaattgacagtagttgtgggtgatataattggggtcttagagcaagggaaaagaacactgacaccacaacccatggagctaaaatattcgtggaaaacatggggaaaggcgaaaatagtgacagctgagacacaaaattcctccttcataatagatgggccaaacacaccagagtgtccaagtgcctcaagagcatggaatgtgtgggaggtggaagattacgggttcggagtcttcacaactaatatatggctgaaactccgagagatgtacacccaactatgtgaccacaggttaatgtcggcagccgttaaggatgagagagccgtacacgccgacatgggctattggatagaaagccaaaagaatggaagttggaaactagaaaaggcatccctcatagaggtgaaaacatgcacatggccaaaatcacacactctctggagcaatggcgtgctagagagtgacatgatcatcccaaagagtctggctggtcctgtctcgcaacacaactacaggcccggatatcacacccaaacggcaggaccttggcacctaggaaaattggagctggatttcaactattgtgaaggaacaacagttgtcatcacagaaagttgtgggacgagaggcccatcactgaggacaacaacagtgtcagggaagttgatacacgaatggtgttgccgctcgtgtacacttcctcccctgcgatacatgggagaagacggctgttggtatggcatggaaattagacccattaatgagaaagaagagaacatggtaaagtctttagtctcagcagggagtggaaaggtggacaacttcacaatgggtgttttatgtttggcaatcctctttgaagaggtgatgagaggaaaattcgggaaaaagcacatgattgcaggggttctctttacatttgtgctccttctctcagggcagataacatggagagatatggcgcgcacactcataatgattgggtccaacgcctctgacagaatgggaatgggcgtcacttacctagcattgattgcaacatttaaaattcagccatttttggctttgggattcttcctgaggaaactgacatctagagaaaatttattgttgggagttgggctggccatggcaacaacgttacaactgccagaggacattgaacaaatggcgaatggaatagctttggggctcatggctctcaaattgataacgcaatttgaaacataccaactatggacggcattagtctccctaatgtgttcaaacacaatcttcacgttgactgttgcctggagaacagccaccctgattttggccggaatttcgcttctgccagtgtgccagtcttcgagcatgaggaaaacagattggctcccagtgactgtggcagctatgggagttccacccctaccactgtttatcttcagtttgaaagatacgctcaaaaggagaagctggccactaaatgagggggtgatggccgttggacttgtgagcattctagcaagttctctccttaggaatgacgtacccatggctggaccattagtggctgggggcttgctgatagcgtgctacgtcataactggcacgtcagcagacctcactgtagaaaaagcagcagatgtgatatgggaggaagaggctgagcaaacaggagtgtcccacaatttaatgatcacagttgatgatgatggaacaatgagaataaaagacgatgagactgagaacatcctaacagtactattgaaaacagcattactaatagtgtcaggcatttttccatactccatacccgcaacactgttggtctggcacacttggcaaaagcaaacccaaagatccggcgtcctatgggacgtacccagccccccagagacacagaaagcagaactggaagaaggggtctataggattaagcagcaaggaatttttgggaagacccaagtgggggttggagtgcaaaaagaaggagttttccacaccatgtggcacgtcacaagaggagcagtgctgacacataatgggaagagactggaaccaaactgggctagcgtgaagaaggatctgatttcatacggaggaggatggagactgagtgcacaatggcaaaaaggagaagaggtgcaggttgttgccgtagagcctgggaagaacccaaaaaacttccaaaccatgccaggcattttccagacaacaacgggggagataggagcgattgcactggacttcaagcctgggacttcaggatctcccatcataaacagagagggaaaggtagtgggactgtatggcaatggagtggtcacaaagaatggtggctatgtcagtggaatagctcaaacaaacgcagaaccagacggaccgacaccagacttggaagaagagatgttcaaaaagcgaaatctaaccataatggatctccatcccgggtcaggaaagacgcggaaatacctcccagctattgttagagaagcaatcaaaagacgcttaaggactctaattttggcaccaacaagggtggtcgcagctgagatggaagaagcattgaaagggctcccaataaggtatcaaacaactgcaacaaaatctgtacacacagggaaagagattgttgatctaatgtgtcacgcaacattcacaatgcgtttgctgtcaccagtcagagttccaaactataacttgataataatggatgaggctcatttcacagacccagctagcatagcagctagagggtacatatcaactcgtgtaggaatgggagaggcagccgcaattttcatgacagccacgccccctggcacagctgatgcctttcctcagagcaatgccccaattcaagatgaagaaagagacataccagaacgctcatggaattcaggtaatgaatggattaccgactttgccgggaagacggtgtggtttgtccctagcatcaaagctgggaatgacatagcaaactgcttgcggaaaaatggaaaaaaggtcattcaacttagtaggaagacttttgacacagaatatcaaaagactaaactaaatgattgggactttgtggtgacaacagacatttcagaaatgggagccaacttcaaagcagacagagtgatcgacccaagaagatgtctcaagccagtcattttgacagacggacccgagcgcgtgatcctggcgggaccaatgccagtcaccgtagcgagcgccgcgcaaaggagagggagagttggcaggaacccacaaaaggaaaatgaccaatacatattcacgggccagcccctcaataatgatgaagaccacgcccactggacagaagcaaaaatgctgctagacaacatcaacacaccagaagggattataccagctctctttgaaccagaaagggagaagtcagccgccatagacggcgaataccgcctgaaaggtgaatccaggaagaccttcgtggaactcatgaggaggggtgacctcccagtttggctagcccataaagtagcatcagaaggaatcaaatatacagacagaaaatggtgttttgatggagaacgcaacaaccaaattttagaagaaaatatggatgtggaaatctggacaaaggaaggagaaaagaaaaaattgaggcctaggtggcttgatgcccgcacctattcagatcccttagcgctcaaggaattcaaggactttgcggctggtagaaagtcgatcgcccttgatcttgtgacagaaataggaagagtgccttcacacctagcctacagaacgagaaacgctctggacaatctagtgatgttgcacacgtcagaacatggcgggagggcttacaggcatgcagtggaggaattaccagaaacaatggaaacactcttactcctgggactcatgatcctgctaacaggtggggcaatgcttttcttgatatcaggtaaagggattggaaaaacttcaataggactcatttgtgtagttgcttccagcggtatgttatggatggctgatgtcccactccaatggatcgcgtcggccatagtcctggagttttttatgatggtgctacttataccagaaccagaaaagcagagaactccccaagacaatcaactcgcatatgttgtgataggcatactcacattggctgcaatagtggcagccaatgaaatgggattgttggaaaccacaaagagagatttaggaatgtccaaagaaccaggtgttgtttctccaactagctatttggatgtggatttgcacccagcatcagcctggacattgtacgctgtggccacaacagtaataacaccaatgttgagacacaccatagagaattccacagcaaatgtgtccctggcagctatagccaaccaggcagtggtcctgatgggtttagacaaaggatggcctatatcgaaagtggacttaggcgtaccactattggcactgggttgctattcgcaagtgaacccactaactctcacagcggcagtactcctgctagtcacgcattatgccattataggtccaggattgcaggcaaaagccactcgtgaagcccaaaaaaggacagctgctggaataatgaagaatccaacggtggatgggataatgacaatagacctagatcctgtaatatacgattcaaaatttgaaaagcaactaggacaggttatgctcctggttctgtgtgcagttcaacttttgttgatgagaacatcatgggcattttgtgaagctctaaccctagccacaggaccaataacaacactctgggaagggtcacctgggaagttctggaacaccacgatagctgtttccatggcgaacatctttagagggagctatttagcaggagctgggcttgctttttctatcatgaaatcagttggaacaggaaagagaggaacagggtcacaaggtgaaaccttgggagaaaagtggaaaaagaaattgaatcaattatctcggaaagagtttgacctttacaagaaatccggaatcactgaagtggatagaacagaagccaaagaagggttgaaaagaggagaaacaacacaccatgccgtatccagaggcagcgcgaaacttcaatggttcgtggagagaaacatggtcatccctgaaggaagagtcatagacttgggctgtggaagaggaggctggtcatattattgtgcaggactgaaaaaagttacagaagtgcgaggatacacaaaaggcggcccaggacatgaagaaccagtacctatgtctacatacggatggaacatagtcaagctaatgagtggaaaggatgtgttttatcttccgcctgaaaagtgtgacactttattgtgtgacattggagaatcttcaccaagcccaacagtggaagaaagcagaaccataagagtcttgaagatggttgaaccatggctaaaaaataaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcacagttcaacatggcactatgatgaagaaaatccttataaaacgtgggcttaccatggatcctatgaagttaaggccacaggctcagcctcctccatgataaatggagttgtgaaactcctcacgaaaccatgggatgtggtgcccacggtgacacagatggcaatgacggatacaacccctttcggccagcaaagggttttcaaagagaaagtggacaccaggacacctagacccatgccaggaacaagaaaggctatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgcgtctacaacatgatgggcaagagagagaagaaactcggagagtttggcaaagcaaaaggcagtagagccatatggtacatgtggttgggagctaggtaccttgagttcgaggcgctcggattcttaaatgaagaccattggttctcgcgtgaaaactctttcagtggagtagaaggggaaggactgcataaactgggatacatcttgagagacatttccaagatacccggaggagccatgtatgctgatgacacagctggttgggacacaagaataacagaagatgacctgcacaatgaggaaaaaatcacgcagcaaatggaccctgaacacaggcaattagcaaacgccatatttaagctcacataccaaaacaaagtggtcaaggttcaacgaccaactccaaagggcacggtgatggacatcatatctaggaaagaccaaagaggcagtggacaggtgggaacttatggtctgaatacattcaccaacatggaagttcagttaatcagacaaatggaaggagaaggtgtgctgtcgaaggcagacctcgagaaccctcatctgctagagaaggaaattacacaatggttggaaactaaaggagtggagaggttaaaaagaatggccatcagcggggatgattgcgtggtgaaaccaatcgatgacaggttcgccgatgccctgcttgccctgaatgacatggggaaagttaggaaggacataccacaatggcagccatcgaaaggatggcatgattggcaacaggttcctttctgctcccaccactttcatgaattgatcatgaaagatggaagaaagttggtagtcccctgcagacctcaggatgaattaatagggagagcgagaatctctcaaggagcaggatggagccttaaagaaactgcatgcctggggaaagcctacgcccaaatgtgggctctcatgtattttcacagaagagatctcagactagcatccaacgccatatgttcagcagtacctgtccactgggtccccacaagcaggacgacgtggtccattcatgctcaccatcagtggatgaccacagaggacatgcttactgtttggaacagggtgtggatagaggacaatccatggatggaagataaaactccagtcacaacttgggaagatgttccatatctagggaagagagaagaccaatggtgcggatcactcattggtcttgcttccagagcaacctgggcccaaaacatacttaccgcaatccaacaggtaagaagccttataggcaatgaagagtttctggactacatgccttcgatgaagagatttaggaaggaggaggagtcagagggagccatttggtaa

SEQ ID NO: 7720 - RNA, 9873 nt, synthetic construct
  misc_feature 1..9873: note = derived and/or modified CDS sequence (wt) from DENV-3__KC762690__SS-prME
  source 1..9873: mol_type = other RNA
acatcgctctgcctcatgatgatgttaccagcaacacttgctttccacctgacttcacgagatggagagccgcgcatgattgtggggaagaatgaaagagggaaatcccttctcttcaagacagcctctggaattaacatgtgcacactcatagccatggatttgggagagatgtgtgatgacacggtcacttacaaatgcccccttatcactgaagtggagcctgaggacattgactgctggtgcaacctcacatcgacgtgggtgacctacggaacgtgcaaccaagctggagagcatagacgcgataagagatcggtggcgttagctccccatgtcggcatgggactggacacacgcgcccaaacctggatgtcggctgaaggagcttggagacaagttgagaaggtagagacatgggcttttaggcacccagggttcacaatactagccctatttcttgcccattacataggcacttccttgacccagaaagtggtcattttcatactactgatgctggtcaccccatccatgacaatgagatgtgtgggagtaggaaacagagatttcgtggaaggcctatcaggagctacgtgggttgacgtggtgctcgagcacggtgggtgtgtgactaccatggctaagaacaagcccacgctagatatagagctccagaagaccgaggccactcaactggcgaccctaaggaaactatgtattgaggggaaaatcaccaacgtaacaaccgactcaaggtgccccacccaaggggaagcgattttacctgaggaacaggaccagaactacgtgtgtaagcacacatacgtggacagaggctgggggaacggttgtggtttgtttggcaagggaagcttggtaacatgcgcgaagtttcaatgtttggaatttatagagggaaaagtggtgcagcatgagaacctcaaatacaccgtcatcatcacagtgcacacaggagaccaacatcaggtgggaaatgaaacgcagggagtcacggctgagataacacctcaggcatcaaccgtcgaagccatcttacctgaatatggaacccttgggctagaatgctcaccacggacaggtttggatttcaatgaaatgattttgttgacaatgaagaacaaagcatggatggtacatagacagtggtttttcgacctacctctaccatggacatcaggggccacaacagaaacaccaacctggaacaagaaagagcttcttgtgacatttaaaaatgcacacgcaaagaaacaagaagtagtagtccttggatcgcaagagggagcaatgcacacagcactgacaggagccacagagatccaaacctcaggaggcacaagtatttttgcggggcatttaaagtgcagactcaagatggacaaattggaactcaaggggatgagctatgcaatgtgcttaaatgcctttgtgttgaagaaagaagtctccgaaacacaacatgggacaatactcattaaggttgagtacaaaggggaagatgcaccttgcaagattcctttctccacggaggatggacagggaaaagcccacaatggcagactgatcacagctaacccagtggtgaccaagaaggaggagcctgtcaatattgaggcagaacctccttttggggaaagtaacatagtaattggaattggagacaaagctttgaaaatcaactggtacaagaagggaagctcgattgggaagatgttcgaggccactgccagaggtgcaaggcgcatggccatcttgggagacacagcctgggactttggatcagtaggtggtgttttaaattcattagggaaaatggtgcaccaaatatttggaagtgcttacacggccctatttagtggagtctcttggataatgaaaattggaataggcgtccttttaacctggatagggttgaattcaaaaaacacttctatgtcattttcatgcattgtgatagggatcatcacactctatctgggagccgtggtgcaagctgacatggggtgtgtcataaactggaaaggcaaagaactcaaatgtggaagcgggattttcgttaccaatgaggtccacacctggacagagcaatacaaatttcaagcagactcccctaagagactggcaacagccattgcaggcgcctgggaaaatggagtgtgcggaatcaggtcgacaaccagaatggagaaccttttgtggaagcaaatagccaatgaactgaactacatattatgggaaaacaacatcaaattgacggtagttgtgggtgatataattggggtcttagagcaagggaaaagaacattgacaccacaacccatggagctgaaatattcgtggaaaacatggggaaaggcgaaaatagtgacagctgagacacaaaattcctccttcataatagatgggccaaacacaccagagtgtccaagtgcctcaagagcatggaatgtgtgggaggtggaagattacgggttcggagtcttcacaactaatatatggctgaaacttcgagagatgtacacccaactatgtgaccacaggctaatgtcggcagccgttaaggatgagagagccgtacacgccgacatgggctattggatagaaagccaaaagaatggaagttggaaactagaaaaggcatccctcatagaggtgaaaacctgcacatggccaaaatcacacactctctggagcaatggcgtgctggagagtgacatgatcatcccaaagagtctggctggtcctgtttcgcaacacaactacaggcccggatatcacacccaaacggcaggaccttggcacctaggaaaattggagctggatttcaactattgtgaaggaacgacagttgtcatcacagaaaattgtgggacaagaggcccatcactgaggacaacaacagtgtcagggaagttgatacacgaatggtgttgccgctcatgtacacttcctcccctgcgatacatgggagaagacggctgttggtatggcatggaaattagacccattaatgagaaagaagagaacatggtaaagtctttagtctcagcagggagtggaaaggtggataacttcacaatgggtgttttatgtctggcaatcctctttgaagaggtgatgagaggaaaattcggaaaaaagcacatgattgcaggggttctctttacatttgtgctccttctctcagggcagataacatggagagatatggcgcgcacactcataatgattgggtccaacgcctctgacagaatgggaatgggcgtcacttacctagcattgattgcaacatttaaaattcagccatttttggctttgggattcttcctgaggaaactgacatctagagaaaatttattgttgggagttgggctggccatggcaacaacgttacaactgccagaggatattgaacaaatggcgaatggaatagctttggggctcatggctctcaaattgataacacaatttgaaacatatcaactatggacggcattagtttccctaatgtgttcaaacacaattttcacgttgactgttgcctggagaacagccaccctgattttggccggaatttcgcttttgccagtgtgccagtcttcgagcatgaggaaaacagattggctcccagttactgtggcagccatgggagttccacccctaccactgtttatcttcagtttgaaagatacgctcaaaaggagaagctggccactaaatgagggggtgatggccgttggacttgtgagcattctagcaagttctctccttaggaatgacgtacccatggctggaccattagtggctgggggcttgctgatagcgtgctacgttataactggcacgtcagcagacctcactgtagaaaaagcagcagatgtgatatgggaggaagaggctgagcagacaggagtgtcccacaatttaatgatcacagttgatgatgatggaacaatgagaataaaagatgatgagactgagaacatcctaacagtgctattgaaaacagcattactaatagtgtcaggcatttttccatactccatacccgctacactgttggtctggcacacttggcaaaagcaaacccaaagatccggcgtcctatgggacgttcccagccccccagagacacagaaagcagaactggaagaaggggtctataggattaagcagcaaggaatttttgggaagacccaagtgggggttggagtacaaaaagaaggagttttccacaccatgtggcacgtcacaagaggagcagtgctgacacacaacgggaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaacttccaaaccatgccaggcattttccagacaacaacaggagagataggagcgattgcactggactttaagcctgggacttcaggatctcccatcataaacagagagggaaaggtagtgggactgtatggcaatggagtggtcacaaagaatggtggctatgtcagtggaatagctcaaacaaacgcagaaccagacggaccgacaccagagttggaagaagagatgttcaagaagcggaatctaaccataatggatctccatcccgggtcaggaaagacgcggaaatacctcccagctattgttagagaagcaatcaaaagacgcttaaggactctaattttggcaccaacaagggtggtcgcagctgagatggaagaagcattgaaggggctcccaataaggtatcaaacaactgcaacaaaatctgcacacacagggaaagagattgttgatctaatgtgtcacgcaacattcacaatgcgtttactgtcaccagtcagagttccaaactataacttgataataatggatgaggctcattttacagacccagctagcatagcggctagagggtacatatcaactcgtgtaggaatgggagaggcagccgcaattttcatgacagccacgccccctggcacagctgatgcctttcctcagagcaatgccccaattcaagatgaagaaagagacataccagaacgctcatggaattcaggtaatgaatggattaccgactttgccgggaagacggtgtggtttgtccctagcatcaaagctggaaatgacatagcaaactgcttgcggaaaaatggaaaaaaggtcattcaacttagtaggaagacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagcgccgcgcaaaggagagggagagttggcaggaacccacaaaaggaaaatgaccaatacatattcacgggccagcccctcaataatgatgaagaccacgctcactggacagaagcaaaaatgctgctagacaacatcaacacaccagaagggattataccagctctctttgaaccagaaagggagaagtcagccgccatagacggtgaataccgcctgaaaggtgaatccaggaagaccttcgtggaactcatgaggaggggtgacctcccagtttggctagcccataaagtagcatcagaaggaatcaaatatacagacagaaaatggtgctttgatggagaacgcaacaaccaaattttagaagaaaatatggatgtggaaatctggacaaaggaaggagaaaagaaaaaattgaggcctaggtggcttgatgcccgcacctattcagatcccttagcgctcaaggaattcaaggactttgcggctggtagaaagtcgatcgctcttgatcttgtgacagaaataggaagagtgccttcacacctagcccacagaacgagaaacgctctggacaatctggtgatgttgcacacgtcagaacatggtgggagggcttacaggcatgccgtggaggaattaccagaaacaatggaaacactcttactcctgggactcatgatcctgttaacaggtggggcaatgcttttcttgatatcaggtaaagggattggaaagacttcaataggactcatttgtgtggttgcttccagcggtatgttatggatggctgatgtcccactccaatggatcgcgtcggccatagtcctggagttttttatgatggtgctacttataccagaaccagaaaagcagagaactccccaagacaatcaactcgcatatgttgtgataggcatactcacattggctgcaatagtggcagccaatgaaatgggattgttggaaaccacaaagagagatttaggaatgtccaaagaaccaggtgttgtttctccaactagctatttggatgtggatttgcacccagcatcagcctggacattgtacgctgtggccacaacagtaataacaccaatgttgagacacaccatagagaattccacagcaaatgtgtccctggcagctatagccaaccaggcagtggtcctgatgggtttagacaaaggatggccgatatcgaaaatggacttaggcgtaccactattggcactgggttgctattcgcaagtgaacccactaactctcacagcggcagtactcctgctagtcacgcattacgccattataggtccaggattgcaggcaaaagccactcgtgaagcccaaaaaaggacagctgctggaataatgaagaatccaacggtggatgggataatgacaatagacctagatcctgtaatatacgattcaaaatttgaaaagcaactaggacaggttatgctcctggttctgtgtgcagttcaacttttgttaatgagaacatcctgggcattttgtgaagctctaaccctagccacaggaccaataacaacactctgggaagggtcacctgggaagttctggaacaccacgatagctgtttccatggcgaacatctttagagggagctatttagcaggagctgggcttgctttttctatcatgaaatcagttggaacaggaaagagaggaacagggtcacaaggtgaaaccttgggagaaaagtggaaaaagaaattgaatcaattatctcggaaagaatttgacctttacaagaaatccggaatcactgaagtggatagaacagaagccaaagaagggttgaaaagaggagaaataacacaccatgccgtatccagaggcagcgcgaaacttcaatggttcgtggagagaaacatggtcatccctgaaggaagagtcatagacttgggctgtggaagaggaggctggtcatattattgtgcaggactgaaaaaagttacagaagtgcgaggatacacaaaaggcggcccaggacatgaagaaccagtacctatgtctacatacggatggaacatagtcaagctaatgagtggaaaggatgtgttttatcttccacctgaaaagtgtgacactctattgtgtgacattggagaatcttcaccaagcccaacagtggaagaaagcagaaccataagagtcttgaagatggttgaaccatggctaaaaaataaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcacagttcaacatggcactatgatgaagaaaatccttataaaacgtgggcttaccatggatcctatgaagttaaggccacaggctcagcctcctccatgataaatggagttgtgaaactcctcacgaaaccatgggatgtggtgcccacggtgacacagatggcaatgacggatacaacccctttcggccagcaaagggttttcaaagagaaagtggacactaggacacctagacccatgccaggaacaagaaaggctatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaactgggcaagtgtggaagctgcgtctacaacatgatgggcaagagagagaagaaactcggagagtttggcaaagcaaaaggcagtagagccatatggtacatgtggttgggagctaggtaccttgagttcgaggcgctcggattcttaaatgaagaccattggttctcgcgtgaaaactctttcagtggagtagaaggggaaggactgcataaactgggatacatcttgagagacatttccaagataccaggaggagctatgtatgctgatgacacagctggttgggacacaagaataacagaagatgacctgcataacgaggaaaaaatcacgcagcaaatggagcctgaacacaggcaattagcaaacgccatatttaagctcacataccaaaacaaagtggtcaaggttcaacgaccaactccaaagggcacggtgatggacatcatatctaggaaagaccaaagaggcagcggacaggtgggaacttatggtctgaatacatttaccaacatggaagttcagttaatcagacaaatggaaggagaaggtgtgctgtcgaaggcagacctcgagaaccctcatctgctagagaaggaaattacacaatggttggaaactaaaggagtggagaggttaaaaagaatggccatcagcggggatgattgcgtggtgaaaccaatcgatgacaggttcgccgatgccctgcttgccctgaatgacatggggaaagttaggaaggacatacctcaatggcagccatcgaagggatggcatgattggcaacaggttcctttctgctcccaccactttcatgaattgatcatgaaagatggaagaaagttggtagtcccctgcagacctcaggatgaattaatagggagagcgagaatttctcaaggagcaggatggagccttaaagaaactgcatgcctggggaaagcctacgcccaaatgtgggctctcatgtattttcacagaagagatctcagactagcatccaacgccatatgttcagcagtacctgtccactgggtccccacaagcaggacgacgtggtccattcatgctcaccatcagtggatgaccacagaggacatgcttactgtttggaacagggtgtggatagaggacaatccatggatggaagataaaactccagtcacaacttgggaagatgttccatacctagggaagagagaagaccaatggtgcggatcactcattggtcttgcttccagagcaacctgggcccaaaacatacttaccgcaatccaacaggtaagaagccttataggcaatgaagagtttctggactacatgccttcgatgaagagattcaggaaggaggaggagtcagagggagccatttggtaa

SEQ ID NO: 7721 - RNA, 9873 nt, synthetic construct
  misc_feature 1..9873: note = derived and/or modified CDS sequence (wt) from DENV-3__KC762691__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacatgggtgacctacggaacgtgcaaccaagccggagagcatagacgcgataagagatcggtggcgttagctcctcatgtcggcatgggactggacacacgcgcccaaacctggatgtcggctgaaggagcttggagacaagtcgagaaggtagagacatgggcttttaggcacccagggttcacaatactagccctatttcttgcccattacataggcacttccttgacccagaaagtggtcattttcatactactaatgctggtcaccccatccatgacaatgagatgtgtgggagtaggaaacagagatttcgtggaaggtctatcaggagctacatgggttgacgtggtgctcgaacacggtgggtgtgtgactaccatggctaagaacaagcccacgctggacatagagctccagaagaccgaggccacccaactggcaaccctaaggaaactatgcattgagggaaaaatcaccaacgtgacaaccgactcaaggtgccccacccaaggggaagcgattctacctgaggagcaggaccagaactacgtgtgtaagcacacatacgtggacagaggctggggaaatggttgtggtttgtttggcaagggaagcttggtaacatgcgcgaaatttcaatgtctggaattaatagagggaaaagtggttcagcatgagaacctcaaatacaccgttatcatcacagtgcatacaggagaccaacaccaggtgggaaatgaaacgcagggagtcacggctgaaataacaccccaggcatcaaccgtcgaagccatcttacctgaatatggaacccttgggctagaatgctcaccacggacaggtttggatttcaatgaaatgatcttgttgacaatgaaggacaaagcatggatggtgcatagacaatggttttttgacctacctctaccatggacatcaggggctacaacagaaacaccaacctggaataagaaagagcttcttgtgacattcaaaaacgcacacgcaaaaaaacaagaagtagtagtccttggatcgcaagagggagcaatgcacacagcactgacaggagctacagagatccaaacctcaggaggcacaagtatctttgcgggacacttgaaatgcagactcaagatggacaaattggaactcaaggggatgagctatacaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagctcacaatggcagactgatcacggctaacccagtggtgaccaagaaggaagagcctgtcaatattgaggcagaacccccttttggggaaagtaacataataattggaattggagacaaagccttgaaaatcaattggtacaagaaggggagctcgattgggaagatgttcgaggcaactgccaggggtgcaaggcgcatggccatcttgggagacacagcctgggactttggatcagtaggtggtgttttaaattcactggggaaaatggtgcaccaaatatttggaagtgcttacacggccctttttagtggagtctcctggataatgaaaattggaataggtgtccttttaacttggatagggttgaattcaaaaaacacttctatgtcattttcatgcattgtgataggaatcatcacactctatctgggagccgtggtgcaagctgacatggggtgtgtcataaattggaaaggcaaagaactcaaatgtggaagtggaattttcgttactaatgaggtccacacctggacagagcaatacaaatttcaagcagactcccccagaagactggcgacagccattgcaggagcctgggagaatggagtgtgcggaatcaggtcgacaaccagaatggagaacctcttgtggaagcaaatagctaatgaactaaactacatattatgggaaaacaacatcaaattaacggtagttgtgggtgacacaattggggtcttagagcaagggaaaagaacactaacaccacaacccatggagctaaaatattcatggaaaacatggggaaaagcgaaaatagtgacagctgaaacacaaaattcatcctttataatagatgggccaaacacaccagagtgtccaaatgcctcaagagcatggaatgtgtgggaggtggaagattacgggttcggagtcttcacaactaacatatggctgaaactccgagagatgtacacacaactatgtgaccacaggctaatgtcggcagccgttaaggatgagagagccgtacacgccgacatgggctattggatagaaagccaaaagaatggtagttggaagctagaaaaggcatctctcatagaggtaaaaacctgcacatggccaaaatcacacactctctggagcaatggtgtgttggagagtgacatgatcatcccaaagagtctggctggtcctatctcgcaacacaactacaggcctggataccacacccaaacggcaggaccctggcacctaggaaaattggagctggacttcaactattgtgaaggaacaacagttgtcatcacagaaaattgtggggcaagaggcccatcactgaggacaacaacagtgtcagggaaattgatacacgaatggtgttgccgctcgtgtacacttcctcccctgcgatatatgggagaagatggctgctggtatggcatggaaattagacccattaatgagaaagaagagaacatggtaaagtctttagtctcagcagggagtggaaaggtggataacttcacaatgggtgtcttgtgtcttgcaatcctcttcgaagaggtaatgaggggaaaattcgggaaaaagcacatgattgcaggggttctcttcacatttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatctagagaaaatttattattgggagttgggttggccatggcaacaacgttgcaactgccagaagacattgaacaaatggcgaatggaatagccttggggctcatggctcttaaattgataacacaatttgaaacataccaactatggacggcattagtctccctaatgtgttcaaacacaattttcacgttgactgttgcctggagaacagccaccctgattttggccggaatttcgctttttccagtgtgccagtcttcgagcatgaggaaaacagattggctcccaatgactgtggcagctatgggagttccacctttaccactttttattttcagtttgaaagacacacttaaaaggagaagctggccactgaatgagggggtgatggccgttggacttgtgagtatcctagcaagttctctccttaggaatgacgtacccatggctggaccattagtggctgggggcttgctgatagcgtgttacgtcataactggcacgtcagcagatctcactgtagaaaaagcagcagatgtgacatgggaggaagaagctgagcaaacgggagtgtcccacaatctaatgatcacagttgatgatgatggaacaatgagaataaaagatgatgagactgagaacatcttaacagtgcttttgaaaacagcactactaatagtgtcaggcatttttccatactccatacctgcaacacttctggtttggcacacttggcaaaagcaaacccaaagatccggcgtcctgtgggacgtacccagccctccagagacacagaaagcagaactggaagaaggggtctataggatcaagcagcaaggaatttttggaaagacccaagtgggggttggagtacaaaaagaaggagttttccacactatgtggcacgtcacaagaggagcagtgttgacatacaatggaaaaagattggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggactttaaacctggaacttcaggatctcccatcataaacagagagggaaaggtagtgggactatatggcaatggagtggtaacaaagaatggtggctatgtcagtggaatagctcaaacaaacgcagaaccagacggaccgacaccagagttggaagaagagatgttcaaaaagcgcaatctaaccataatggatctccatcccgggtcaggaaagacgcggaaatacctcccagccatagttagagaggcaatcaagagacgcttaaggactctaattttggcaccaacaagggtggttgcagctgagatggaagaagcactgaaagggctcccaataaggtatcaaacaaccgcaacaaaatctgaacatacagggaaagagattgttgatctaatgtgccacgcaacgttcacaatgcgtttgctgtcaccagtcagagttccaaactacaacttgataataatggatgaggctcatttcacagacccagccagtatagcagctagggggtacatatcaactcgtgtaggaatgggagaggcagccgcaatttttatgacggccacacctcctggaacagctgatgcctttcctcagagcaacgctccaattcaagatgaagaaagagacataccagaacgctcatggaattcaggcaatgattggattactgactttgctgggaagactgtgtggtttgtccccagcatcaaagctgggaatgacatagcaaactgcttgcggaaaaatggaaaaaaggtcattcaacttagtaggaaaacttttgatacagaatatcaaaagactaaactaaatgattgggactttgtggtgacaacagacatttcagaaatgggagccaatttcaaagcagacagagtgatcgacccaagaagatgcctcaagccagtcattttgacggacggacccgagcgcgtgatcctggcgggaccaatgccagtcaccgtagcgagtgctgcgcaaaggagagggagaattggcaggaacccacaaaaagaaaatgaccaatacatattcacgggccagcccctcaacaatgatgaagaccacgctcactggacagaagcgaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggaaaatatggatgtggaaatctggacaaaggaaggagaaaagaaaaaattgaggcctaggtggcttgatgcccgcacttattcagatcccttagcgctcaaagaattcaaggactttgcggctggtagaaagtcgatcgcccttgatcttgtgacagaaataggaagagtgccttcacatctagcccacagaacgagaaacgctctggacaatctggtgatgttgcacacgtcagaacacggtgggagggcctacaggcatgcagtggaggaattaccagaaacaatggaaacactcttactcctgggactcatgatcctgttaacaggtggggcgatgctcttcttgatatcaggcaaaggggttggaaagacttcaataggactcatttgtgtagttgcttccagcggcatgttatggatggctgatatcccactccaatggatcgcgtcggccatagtcttggagttctttatgatggtgctacttataccagaaccagaaaagcagagaactccccaagacaatcaactcgcatatgtcgtgataggcatacttacattggctgcaatagtagcggccaatgaaatgggattgttggaaaccacaaagagagatttggggatgtccaaagaaccaggtgttgtttcgccaaccagttatttggatgtggatttacacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccaatatcgaaaatggacttaggcgtgccactattggcactgggttgctattcacaagtgaacccactaactctcacagcggcagtactcctgctagtcacgcattatgctattataggtccaggattgcaggcaaaagccactcgtgaagctcaaaaaagaacggctgctggaataatgaagaatccaacggtggatgggataatgacaatagacctagatcctgtaatatacgactcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttctggaacaccacgatagctgtttctatggcaaacatctttagagggagctatctagcaggagctgggcttgctttttctatcatgaaatcagttggaacaggaaagagaggaacagggtcacaaggtgaaactttgggagaaaagtggaaaaagaaactgaatcaattatcccggaaagagtttgacctctacaagaaatccggaatcactgaagtggatagaacagaagccaaagaagggttgaaaagaggagaaataacacaccatgccgtatccaggggcagcgcaaaacttcaatggttcgtggagagaaacatggtcattcctgaaggaagagtcatagacttgggctgtggaagaggaggctggtcatattactgtgcaggattgaaaaaagttacagaagtgcgaggatacacaaaaggcggtccaggacatgaagaaccagtacctatgtctacatatggatggaacatagtcaagctgatgagtggaaaggatgtgttttatcttccacctgaaaagtgtgacactctattgtgtgacattggagaatcctcaccaagcccaacagtggaagagagcagaaccataagagtcttgaaaatggttgaaccatggctaaaaaataaccagttttgcattaaagtattgaatccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatataggagacccaccatagagaaagatgtggatttaggagcggggacccgacatgtcaatgcggaaccagaaacacccaacatggatgtcattggggaaagaataagaagaatcaaggaggagcatagttcaacatggcactatgatgatgaaaatccttacaaaacgtgggcttaccatggatcttatgaagttaaggccacaggctcagcctcctccatgataaatggagtcgtaaaactcctcacgaaaccatgggatgtggtgcccacggtgacacagatggcaatgacggacacaaccccttttggccagcaaagggttttcaaagagaaagtggacaccaggacacccaaacccatgccaggaacaagaaaggttatggagattacagcggaatggctttggagaaccctgggaaggaacaaaagacccagattatgcacgagagaggagttcacaaaaaaggtcagaaccaacgcagctatgggcgccgtattcacggaggagaaccaatgggacagcgctagagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccactggttctcgcgtgaaaactcttacagtggagtagaaggggaaggactgcataagctgggatatatcttgagagatatttccaagatacctggaggagccatgtatgctgatgacacagctgggtgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagctgatcagacaaatggaaggagaaggtgtgttgtcgaagacagacctcgagaaccctcatctactagagaagaaaattacacaatggttggaaaccaaaggagtggagaggttaaaaagaatggccatcagcggggatgattgcgtggtgaaaccaatcgacgacaggttcgctaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattgatagggagagcgagaatctctcagggagcaggatggagccttaaagaaactgcatgcctagggaaagcctacgcccaaatgtgggctctcatgtattttcacagaagagatcttagactagcatccaacgccatatgttcagcagtaccagtccattgggtccccacaagcagaacgacgtggtccatccatgctcaccatcagtggatgactacagaagacatgcttactgtttggaacagggtatggatagaggacaatccatggatggaagacaaaactccagtcacaacttgggaagatgttccatatctggggaagagagaggaccaatggtgcggatcactcattggtctcacttccagagcaacctgggcccagaacatacttaccgcaatccaacaggtaagaagccttataggcaatgaagagtttctggactacatgccttctatgaagagattcaggaaggaggaggagtcagagggagccatttggtaa

SEQ ID NO: 7722 - RNA, 9873 nt, synthetic construct
  misc_feature 1..9873: note = derived and/or modified CDS sequence (wt) from DENV-3__KC762692__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgttggcatgggactggacacacgcgcccaaacctggatgtcagctgaaggagcttggagacaagtcgagaaggtagagacatgggcctttaggcacccagggttcacaatactagccctatttctcgcccattacataggcacttccttgacccagaaagtggtcattttcatactactaatgctggtcaccccatccatgacaatgagatgtgtgggagtaggaaacagagactttgtagaaggcctatcaggagctacgtgggttgacgtggtgctcgaacacggtgggtgcgtgactaccatggctaagaacaagcccacgctggacatagagctccagaagaccgaggctacccaactggcaaccctaaggaaactatgcattgaggggaaaatcaccaacgtgacaaccgactcaaggtgccccacccaaggggaagcgatcctacctgaggagcaggatcagaactacgtgtgtaagcacacgtacgtggacagaggctggggaaacggttgtggtttgtttggcaagggaagcttggtaacatgcgcgaaatttcaatgtttggaattaatagagggaaaagtggtgcagcatgagaacctcaaatacaccgtcatcattacagtgcacacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtccatagacaatggtttttcgacctacctctaccatggacatcaggggccacaacagaaacaccaacctggaataagaaagagcttcttgtgacattcaaaaacgcacacgcaaaaaaacaagaagtggtagtccttggatcgcaagagggagcaatgcacacagcactgacaggagccacagagatccaaacctcaggaggcacaagtatttttgcggggcacttgaaatgtagactcaagatggacaaattggaactcaaagggatgagctatgcaatgtgctcaaatgcctttgtgttgaagaaagaagtctctgaaacacaacatgggacaatactcattaaggtcgaatacaaaggggaagacgcaccttgcaagattcctttctctacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcctgggagacacagcctgggactttggatcagtaggtggtgttttgaattcactagggaaaatggtgcaccaaatatttggaagtgcttacacggctctttttagtggagtttcctggataatgaaaattggaataggtgtccttttaacttggatagggttgaattcaaaaaacacttctatgtcattttcatgcattgtgataggaatcatcacactctatctgggagccgtggtgcaagctgatatggggtgtgtcataaactggaaaggcaaagaactcaaatgtggaagtggaattttcgtcaccaatgaggtccacacctggacagagcaatacaaatttcaagcagactcccccaaaagactggcgacagccattgtaggcgcctgggagaatggagtgtgtggaatcaggtcgacaaccagaatggagaacctcttgtggaagcaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaaatagtgacagctgaaatacagaattcctcctttataatagatgggccaaacacaccagaatgtccaaatgcctcaagagcatggaatgtgtgggaggtggaagactacgggttcggagtcttcacaactaatatatggctgaaactccgagagatgtacacccaactatgtgaccacaggctaatgtcggcagctgttaaggatgagagagccgtacacgccgacatgggctattggatagaaagccaaaagaatggtagttggaagctagaaaaggcatctctcatagaggtaaaaacctgcacatggccaaaatcacacactctctggagcaatggtgtgttggagagtgacatgatcatcccaaagagtctggctggtcctatctcgcaacacaactacaggcccggataccacactcaaacggcaggaccctggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaattagacccattaatgagaaagaagagaacatggtaaagtctttagtctcagcagggagtggaaaggtggataacttcacaatgggtgtcttgtgtcttgcaatcctctttgaagaggtaatgagaggaaaatttgggaaaaagcacatgattgcaggggttctcttcatgtttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaattgacatccagagaaaatttattattgggagttgggttggccatggcaacaacgttgcaactgccagaggacattgaacaaatggcgaatggaatagccttagggctcatggttcttaaattgataacacaatttgaaacataccaactatggacggcattagtctccctaacgtgttcaaatacaattttcacgttgactgttgcctggagaacagccaccctgatcttggccggaacttcgcttttgccagtgtgccagtcctcgagcatgaggaaaacagattggctcccaatgactgtggcagctatgggagttccacctctaccactttttatctttagtttgaaagacacacttaaaaggagaagctggccactgaatgaaggggtgatggccgttggacttgtgagcattctagcaagttctctccttaggaatgacgtacccatggctggaccattggtggctgggggcttgctaatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtacttttgaaaacagcattactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggggttttccacactatgtggcacgtcacaagaggggcagtgttgacatacaatggaaaaagactggaaccaaactgggccagcgtgaaaaaagatctgatctcatacggaggaggatggagactgagtgcacaatggcaaaaaggagaagaggtgcaggttattgccgtagagcctgggaagaacccaaagaactttcaaaccatgccaggcattttccagacaataacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagatggaccgacaccagagttggaagaagagatgttcaaaaagcgaaatctaactataatggatctccatcccgggtcaggaaagacgcggaaataccttccaactatagtcagagaggcaatcaagagacgcttaaggactctaattttggcaccaactagggtggttgcagctgagatggaagaagcattgaaaggacttccaataaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtatatatcaactcgtgtaggaatgggagaggcagccgcaattttcatgacagccacaccccctggaacagctgatgcctttcctcagagcaacgctccaattcaagatgaagagagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagatatttcagaaatgggagccaatttcaaagcagacagagtgatcgacccaagaagatgtctcaagccagtcattttaacagacggacccgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccacgctcactggacagaagcaaaaatgttgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgaccttccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttggcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagaacacggtgggagggcctacaggcatgcagtggaggaattaccagaaacaatggaaacactcttactcctgggactcatgatcctgttaacaggtggggcgatgctcttcttgatatcaggcaaaggggttggaaagacttcaataggactcatttgtgtggtcgcttccagcggcatgttatggatggctgatatcccactccaatggatcgcgtcggccatagttctggagttttttatgatggtgctactcataccagaaccagaaaagcagagaactccccaagacaatcaactcgcatatgtcgtgataggcatacttacattggctgcaatagtagcagccaatgaaatgggattgttggaaaccacaaagagagatttggggatgtccaaagaaccaggcgttgtctcgccaaccagctatttggatgtggatttgcacccagcatcagcctggacattgtacgctgtggccacaacagtcataacaccaatgttgagacataccatagagaattccacagcaaatgtgtccctggcagctatagccaaccaggcagtggtcctgatgggtttagacaaaggatggccgatatcgaaaatggacttaggcgtgcctctgttggcactgggttgctattcacaagtaaacccactaactctcacagcggcagtactcctgttagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgtgaagctctaaccctagccacaggaccaataacaacactctgggaaggttcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattaaatcaattatcccggaaagagtttgacctctataagaaatccggaatcactgaagtggatagaacagaagccaaagaagggttgaaaagaggagaaataacacaccatgccgtatccagaggcagcgcaaaacttcaatggttcgtggagagaaacatggtcattcccgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctactgtgtgacattggagaatcttcaccaagtccaacagtggaagagagcagaaccataagagtcttgaaaatggttgaaccatggctaaaaaataaccagttttgcattaaagtattgaacccttatatgccaactgtgattgagcacctagaaagattacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatatagaagacccaccatagagaaagatgtggatttgggagcgggaacccgacatgtcaatgcggaaccagaaacacccaacatggatgtcattggggaaagaataagaaggatcaaggaggagcatagctcaacatggcactatgatgatgaaaatccttacaaaacgtgggcttaccatggatcttatgaagtcaaggccacaggctcagcctcctccatgataaatggagtcgtgaagctcctcacgaaaccatgggatgtggtgcccacggtgacacagatggcaatgacggacacaactccttttggccagcaaagggtttttaaagagaaagtggacaccaggacacccaaacccatgccaggaacaagaaagattatggagatcacagcgggatggctttggagaaccctgggaaggaataaaagacccagattgtgcacgagagaggagttcacaaaaaaggtcagaaccaacgcagctatgggcgccgtattcacagaggagaaccaatgggacagtgctagagctgccgttgaagatgaagagttctggaaactcgtggacagagaacgtgaactccacaaacaaggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgacacagctgggtgggacacaagaataacagaagatgacctgcataatgaggaaaaaatcacacagcaaatggaccctgaacacaggcagttagcaaatgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagaaaagaaaattacacaatggttggaaaccaaaggagtggagaggttaaagagaatggccatcagcggggatgattgtgtggtgaaaccaatcgacgacaggttcgccaatgccttgcttgccctgaatgacatgggaaaagttaggaaggacataccccaatggcagccatcgaagggatggcatgattggcaacaggtccctttctgctcccaccactttcatgaattgattatgaaagatggaagaaatttggtagtcccttgcagacctcaggatgaattaatagggagagctagaatctctcagggagcaggatggagccttaaagaaactgcatgcctagggaaagcctacgcccaaatgtgggctctcatgtattttcacagaagagatcttagactagcatccaacgccatatgttcagcagtgccagtccattgggtccccacaagcagaacgacgtggtctatccatgctcaccatcagtggatgactacagaaaacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggctcagaacatacttaccgcaatccaacaggtaagaagccttataggcaatgaagagtttctggactacatgccttcgatgaagagattcaggaaggaggaggagtcagagggagccatttggtaa

SEQ ID NO: 7723 - RNA, 9873 nt, synthetic construct
  misc_feature 1..9873: note = derived and/or modified CDS sequence (wt) from DENV-3__JQ920481__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaaaaattaccaacgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacggtagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagatacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgctagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagatatttccaagatacccggaggagctatgtatgctgatgacacagctggttgggacacaagaataacagaagatgacctgcacaatgaggaaaaaatcacacagcaaatggatcctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgcccaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7724 - RNA, 9873 nt, synthetic construct
  misc_feature 1..9873: note = derived and/or modified CDS sequence (wt) from DENV-3__JQ920483__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccctgacccagaaagtggttattttcatactactaatgctggtcaccccatccatgacaatgagatgtgtgggagtgggaaacagagattttgtggaaggcctatcaggagctacgtgggttgacgtggtgctcgagcacggtgggtgtgtgaccactatggctaagaacaagcccacgttggatatagagctccagaagaccgaggccacccaactggcgaccctaaggaaactatgtattgagggaaaaattaccaatgtaacaaccgactcaaggtgtcccacccaaggggaagcgattttacctgaggagcagaaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgagacgcaacatgggacgatactcattaaggttgagtacaaaggggaagatgcaccttgcaagattcctttctccacggaggacggacaagggaaagcccacaacggcagactgatcacagctaacccaatagtgaccaagaaggaggagcctgtcaacatcgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactatatctgggagctgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacattaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagaagtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgcgaaggaacaacagttgtcatcacagaaaattgtgggataagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaagacggataacttcacaatgggtgtcttgtgtttggcaatcctctttgaagaggtgatgagaggaaaatttgggaaaaaacacatgattgcaggggctctcttcacgtttgtgctccttctctcagggcaaataacatggagagacatggcgcacacactcataatgattgggtccaacgcctctgacagaatgggaatgggcgtcacttacctagcactgattgcaacatttaaaattcagccatttttggctttaggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattaatctccctaatgtgttcaaacacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactaaatgagggggtgatggctgttggacttgtgagcattctagccagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactctatacccgcaacactattggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggagttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaatccaaagaactttcaaaccatgccaggcatttttcagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcagacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagatataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgattgacccaagaagatgtctcaagccagtgatcttgacagacggacccgagcgtgtgatcctggcgggaccaatgccagtcaccgtagcgagcgctgcacaaaggagagggagagttggcaggaactcacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattctagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacacttctactcctgggactcatgatcctgttaacaggtggagcaatgcttttcttgatatcgggtaaagggattggaaagacttcaataggactcatttgtgtagttgcttccagcggtatgttatggatggctgatgttccactccaatggatcgcgtcggccatagtcctggagtttttcatgatggtgttactaataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaatccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgcgcagttcaacttttgttaatgagaacatcatgggctttttgtgaagctctaaccctagccacaggaccaataacaacactctgggaaggatcacctgggaagttctggaacaccacgatagccgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatatggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacttagaaagactacaaaggaaacatggaggaatgcttgtgagaaatccactctcacgaaactccacgcatgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggacacaaccccattcggccagcaaagggtttttaaagagaaagtggacaccaggacacctagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaatcaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcctaaatgaagaccattggttctcgcgtgaaaactctcacagtggagtagaaggagaaggattgcataaactgggatacatcttaagagacatttccaagatacccggaggagctatgtatgctgatgacacagctggttgggacacaagaataacagaagatgacctgcacaatgaggaaaaaatcacacagcaaatggatcctgaacataggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggctgacctcgagaaccctcacctgctagagaggaaagttacacaatggttggaaacaaaaggagtggagaggttaaaaagaatggccatcagcggggatgattgcgtggtgaagccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcaatggatgaccacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7725 - RNA, 9873 nt, synthetic construct
  misc_feature 1..9873: note = derived and/or modified CDS sequence (wt) from DENV-3__JQ920482__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccctgacccagaaagtggttattttcatactactaatgctggtcaccccatccatgacaatgagatgtgtgggagtgggaaacagagattttgtggaaggcctatcaggagctacgtgggttgacgtggtgctcgagcacggtgggtgtgtgaccactatggctaagaacaagcccacgttggatatagagctccagaagaccgaggccacccaactggcgaccctaaggaaactatgtattgagggaaaaattaccaatgtaacaaccgactcaaggtgtcccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagcaacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgagacgcaacatgggacgatactcattaaggttgagtacaaaggggaagatgcaccttgcaagattcctttctccacggaggatggacaagggaaagcccacaacggcagactgatcacagctaacccaatagtgaccaagaaggaggagcctgtcaacatcgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactatatctgggagctgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacattaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagaagtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgcgaaggaacaacagttgtcatcacagaaaattgtgggataagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaagacggataacttcacaatgggtgtcttgtgtttggcaatcctctttgaagaggtgatgagaggaaaatttgggaaaaaacacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaagattcagccatttttggcgttaggattcttcctgaggaaactgacatccagagaaaatctattgctgggagttgggttggccatggcaacaacgttacaactgccagaggacattgaacaaatggcgaatggaatagctttggggctcatggctcttaaattaataacacaatttgaaacataccaactatggacggcattaatctccctaatgtgttcaaacacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactaaatgagggggtgatggctgttggacttgtgagcattctagccagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactattggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggagttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcatttttcagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcagacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagatataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgattgacccaagaagatgtctcaagccagtgatcttgacagacggacccgagcgtgtgatcctggcgggaccaatgccagtcaccgtagcgagcgctgcacaaaggagagggagagttggcaggaactcacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggaaaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagcccacagaacgagaaacgccctggacaatctggtgatgttgcacacgtcagaacatggcgggagggcctacaggcatgcagtggaggaactaccagaaacaatggaaacacttctactcctgggactcatgatcctgttaacaggtggagcaatgcttttcttgatatcgggtaaagggattggaaagacttcaataggactcatttgtgtagttgcttccagcggtatgttatggatggctgatgttccactccaatggatcgcgtcggccatagtcctggagtttttcatgatggtgttactaataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaatccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgcgcagttcaacttttgttaatgagaacatcatgggctttttgtgaagctctaaccctagccacaggaccaataacaacactctgggaaggatcacctgggaagttctggaacaccacgatagccgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggacacaaccccattcggccagcaaagggtttttaaagagaaagtggacaccaggacacctagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcctaaatgaagaccattggttctcgcgtgaaaactctcacagtggagtagaaggagaaggattgcataaactgggatacatcttaagagacatttccaagatacccggaggagctatgtatgctgatgacacagctggttgggacacaagaataacagaagatgacctgcacaatgaggaaaaaatcacacagcaaatggatcctgaacataggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggctgacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcaatggatgaccacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7726 - RNA, 9873 nt, synthetic construct
  misc_feature 1..9873: note = derived and/or modified CDS sequence (wt) from DENV-3__JQ920484__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccctgacccagaaagtggttattttcatactactaatgctggtcaccccatccatgacaatgagatgtgtgggagtgggaaacagagattttgtggaaggcctatcaggagctacgtgggttgacgtggtgctcgagcacggtgggtgtgtgaccactatggctaagaacaagcccacgttggatatagagctccagaagaccgaggccacccaactggcgaccctaaggaaactatgtattgagggaaaaattaccaatgtaacaaccgactcaaggtgtcccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgcagactcaagatggacaaattggaactcaaggggatgagctatgcaatgtgcttgaatgccttcgtgttgaagaaagaagtctctgagacgcaacatgggacgatactcattaaggttgagtacaaaggggaagatgcaccttgcaagattcctttctccacggaggatggacaagggaaagcccacaacggcagactgatcacagctaacccaatagtgactaagaaggaggagcctgtcaacatcgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagcggagtctcctggataatgaaaattggaataggtgtccttttaacctggatagggttgaattcaaaaaacacttctatgtcattttcatgcattgtgataggaatcattacactatatctgggagctgtggtgcaagctgacatggggtgtgtcataaactggaaaggcaaagaactcaaatgtggaagtggaatttttgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacattaaattaacgatagttgtgggtgatgcaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagaagtacacccaactatgtgaccacaggctaatgtcggcagccgttaaggatgagagggccgtacacgccgacatgggctattggatagaaagccaaaagaatggaagttggaagctagaaaaggcatccctcatagaggtgaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgcgaaggaacaacagttgtcatcacagaaaattgtgggataagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaagacggataacttcacaatgggtgtcttgtgtttggcaatcctctttgaagaggtgatgagaggaaaatttgggaaaaaacacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaagattcagccatttttggctttaggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattaatctccctaatgtgttcaaacacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactaaatgagggggtgatggctgttggacttgtgagcattctagccagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactattggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggagttggagtacaaaaagaaggagtttttcacaccatgtggcacgtcacaagaggagcagtgttgacatacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcatttttcagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcagacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagatataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgattgacccaagaagatgtctcaagccagtgatcttgacagacggacccgagcgtgtgatcctggcgggaccaatgccagtcaccgtagcgagcgctgcacaaaggagagggagagttggcaggaactcacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacccaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgttccactccaatggatcgcgtcggccatagtcctggagtttttcatgatggtgttactaataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaatccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgcgcagttcaacttttgttaatgagaacatcatgggctttttgtgaagctctaaccctagccacaggaccaataacaacactctgggaaggatcacctgggaagttctggaacaccacgatagccgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatatggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacttagaaagactacaaaggaaacatggaggaatgcttgtgagaaatccactctcacgaaactccacgcatgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggacacaaccccattcggccagcaaagggtttttaaagagaaagtggacaccaggacacctagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcctaaatgaagaccattggttctcgcgtgaaaactctcacagtggagtagaaggagaaggattgcataaactgggatacatcttaagagacatttccaagatacccggaggagctatgtatgctgatgacacagctggttgggacacaagaataacagaagatgacctgcacaatgaggaaaaaatcacacagcaaatggatcctgaacataggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggctgacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcaatggatgaccacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7727 - RNA, 9873 nt, synthetic construct
  misc_feature 1..9873: note = derived and/or modified CDS sequence (wt) from DENV-3__JQ920486__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgctcattacataggcacttccctgacccagaaagtggttattttcatactactaatgctggtcaccccatccatgacaatgagatgtgtgggagtgggaaacagagattttgtggaaggcctatcaggagctacttgggttgacgtggtgctcgagcacggtgggtgtgtgaccactatggctaagaacaagcccacgttggatatagagctccagaagaccgaggccacccaactggcgaccctaaggaaactatgtattgagggaaaaattaccaatgtaacaaccgactcaaggtgtcccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtctggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtaacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgagacgcaacatgggacgatactcattaaggttgagtacaaaggggaagatgcaccttgcaagattcctttctccacggaggatggacaagggaaagcccacaacggcagactgatcacagctaacccaatagtgaccaagaaggaggagcctgtcaacatcgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactatatctgggagctgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggagaacaacattaaattaacgatagttgtgggtgatgcaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagaagtacacccaactatgtgaccacaggctaatgtcggcagccgttaaggatgagagggccgtacacgtcgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgcgaaggaacaacagttgtcatcacagaaaattgtgggataagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaagacggataacttcacaatgggtgtcttgtgtttggcaatcctctttgaagaggtgatgagaggaaaatttgggaaaaaacacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaagattcagccatttttggctttaggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattaatctccctaatgtgttcaaacacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactaaatgagggggtgatggctgttggacttgtgagcattctagccagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactattggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggagttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcatttttcagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcagacaaccgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagatataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgattgacccaagaagatgtctcaagccagtgatcttgacagacggacccgagcgtgtgatcctggcgggaccaatgccagtcaccgtagcgagcgctgcacaaaggagagggagagttggcaggaactcacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgttccactccaatggatcgcgtcggccatagtcctggagtttttcatgatggtgttactaataccagaaccagaaaagcagagaactccccaagacaatcaactcgcatatgtcgtgataggcatactcacgttggctgcaatagtagcagccaatgaaatgggactgttggaaaccacaaagagagatttgggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaatccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgcgcagttcaacttttgttaatgagaacatcatgggctttttgtgaagctctaaccctagccacaggaccaataacaacactctgggaaggatcacctgggaagttctggaacaccacgatagccgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaatagaagccaaagaagggttgaaaagaggagaaataacacaccatgccgtgtccagaggtagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatatggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacttagaaagactacaaaggaaacatggaggaatgcttgtgagaaatccactctcacgaaactccacgcatgaaatgtactggatatctaatggcacaggcaatatcgtttcttctgtcaacatggtatccagattgctgctgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggacacaaccccattcggccagcaaagggttttcaaagagaaagtggacaccaggacacccagacccatgccaggaacaagaaaggttatggagatcacagcggaatggctttggagaaccctgggaaggaacaaaagacccagactatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcctaaatgaagaccattggttctcgcgtgaaaactctcacagtggagtagaaggagaaggattgcataaactgggatacatcttaagagacatttccaagatacccggaggagctatgtatgctgatgacacagctggttgggacacaagaataacagaagatgacctgcacaatgaggaaaaaatcacacagcaaatggatcctgaacataggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggctgacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcaatggatgaccacagaagatatgcttactgtttggaacagggtgtggatagaggacaatccatggatggaggacaaaactccagtcacaacctgggaagatgttccatatctaggaaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7728 - RNA, 9873 nt, synthetic construct
  misc_feature 1..9873: note = derived and/or modified CDS sequence (wt) from DENV-3__JQ920485__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccctgacccagaaagtggttattttcatactactaatgctggtcaccccatccatgacaatgagatgtgtgggagtgggaaacagagattttgtggaaggcctatcaggagctacgtgggttgacgtggtgctcgagcacggtgggtgtgtgaccactatggctaagaacaagcccacgttggatatagagctccagaagaccgaggccacccaactggcgaccctaaggaaactatgtattgagggaaaaattaccaacataacaaccgactcaaggtgtcccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagttatgcaatgtgcttgaatgccttcgtgttgaagaaagaagtctctgagacgcaacatgggacgatactcattaaggttgagtacaaaggggaagatgcaccttgcaagattcctttctccacggaggatggacaagggaaagcccacaacggcagactgatcacagctaacccaatagtgaccaagaaggaggagcctgtcaacatcgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactatatctgggagctgtggtgcaagctgacatggggtgtgtcataaactggaaaggcaaagaactcaaatgtggaagtggaattttcgtcactaatgaggtccacacctggacagagcaatacaaatttcaagcggactctcctaaaagactggcgacagccattgcaggcgcttgggagaatggagtgtgcggaatcaggtcgacaaccagaatggagaacctcctgtggaagcaaatagctaatgaactgaactacatattatgggaaaacaacattaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagaagcacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgcgaaggaacaacagttgtcatcacagaaaattgtgggataagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaagacggataacttcacaatgggtgtcttgtgtttggcaatcctctttgaagaggtgatgagaggaaaatttgggaaaaaacacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaagattcagccatttttggctttaggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattaatctccctaatgtgttcaaacacaattttcacgttgactgttgcctggagaacagccaccctgattttggccgtaatttctcttttgccagtgtgccagtcttcgagcatgagaaaaacagattggctcccaatgactgtggcagctatgggagttccacccctaccacttttcattttcagtttaaaagacacgctcaaaaggagaagctggccactaaatgagggggtgatggctgttggacttgtgagcattctagccagttctttccttaggaatgacgtgcccatggctggaccattagtggctgggggcttgctgatagcttgctacgtcataactggcacgtcagcagacctcactgtagaaaaagcagcagatgtgacatgggaggaagaggctgaacaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactattggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggagttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcatttttcagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgataccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcggctgagatggaagaagcattgaaagggctcccaataaggtatcagacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagatataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaactcagtaggaagacttttgacacagaatatcaaaagactaaactgaatgattgggactttgtggtgacaacagacatttcagaaatgggagccaatttcaaagcagacagagtgattgacccaagaagatgtctcaagccagtgatcttgacagacggacccgagcgtgtgatcctggcgggaccaatgccagtcaccgtagcgagcgctgcacaaaggagagggagagttggcaggaactcacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgttccactccaatggatcgcgtcggccatagtcctggagtttttcatgatggtgttactaataccagaaccagaaaagcagagaactccccaagacaatcaactcgcatatgtcgtgataggtatactcacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgcagtggccacaacggtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaatccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgcgcagttcaacttttgttaatgagaacatcatgggctttttgtgaagctctaaccctagccacaggaccaataacaacactctgggaaggatcacctgggaagttctggaacaccacgatagccgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaatagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtacgaggatacacaaaaggcggcccaggacatgaagaaccagtacctatgtctacatatggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacttagaaagactacaaaggaaacatggaggaatgcttgtgagaaatccactctcacgaaactccacgcatgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatgaatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggacacaaccccattcggccagcaaagggtttttaaagagaaagtggacaccaggacacctagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagggaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcctaaatgaagaccattggttctcgcgtgaaaactctcacagtggagtagaaggagaaggattgcataaactgggatacatcttaagagacatttccaagatacccggaggagctatgtatgctgatgacacagctggttgggacacaagaataacagaagatgacctgcacaatgaggaaaaaatcacacagcaaatggatcctgaacataggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcaggcaaatggaaggagaaggtgtgttgtcgaaggctgacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcaatggatgaccacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagccagagggagccatttggtaa

SEQ ID NO: 7729 - RNA, 9873 nt, synthetic construct
  misc_feature 1..9873: note = derived and/or modified CDS sequence (wt) from DENV-3__FJ644564__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaggtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttcttgcccattacataggcacctccttgacccagaaggtggttatttttatactactaatgctggtcaccccatccatgacaatgagatgtgtgggagtgggaaacagagattttgtggaaggtctgtcaggagctacgtgggttgacgtggtgctagagcacggggggtgtgtgaccaccatggctaagaacaagcccacgctggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggttgtggtttgtttggcaagggaagcttggtaacatgtgcgaaatttcaatgcctggaaccgatagagggaaaagtggtgcaatatgagaacctcaaatacaccgtcatcattacagtgcacacaggagaccaacaccaggtgggaaatgaaacgcagggagtcacggctgagataacgcctcaggcatcaactactgaagccatcttgcctgaatatggaacccttgggctagaatgctcaccacggacaggtttggacttcaatgaaatgatcttactaacaatgaagaacaaagcatggatggtacacagacaatggttttttgacctacctctaccatggacatcaggagctacaacagaaacaccaacttggaacaggaaggagctccttgtgacattcaaaaatgcacatgcgaaaaaacaagaagtagttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgttaacattgaggctgaacctccttttggggaaagtaatatagtaattggaattggagacaatgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttgacttggatagggttgaattcaaaaaacacatccatgtcattttcatgcattgcgataggaatcatcacactctatctgggagctgtggtgcaagctgacatggggtgtgtcataaactggaaaggcaaagaacttaaatgcggaagtggaattttcgtcaccaacgaggtccatacctggacagagcagtacaaattccaagcagactccccaaaaagattggcgacagccattgcaggcgcttgggagaatggagtgtgcggaattaggtcaacaaccagaatggagaatctcttgtggaagcaaatagccaatgaactgaactacatattatgggaaaacaatatcaaattaacggtagttgtgggcgacacaattggggttttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaaatgtgtgaccataggctaatgtcggcagccgtcaaggatgagagggccgtgcatgccgacatgggctattggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcccatttcgcaacacaaccacaggcccgggtaccacacccaaacggcaggaccctggcacttagaaaatttggagctggacttcacctattgtgaaggaacaacagttgtcatcacagaaaactgtgggacaagaggcccatcattgagaacgacaacagtatcaggaaagttgatacacgaatggtgttgccgctcgtgcacacttcctcctctgcgatacatgggagaagacggctgttggtatggcatggaaatcagacccatcagtgagaaagaagagaacatggtaaagtctttagtctcagcgggaagtggaaaggtagacaacttcacaatgggtatcttgtgcttggcaatcctctttgaagaggtgatgagaggaaaatttgggaagaaacacatgattgcaggggttttcttcacgtttgtgctccttctctcagggcaaataacatggagagacatggcgcacacactaataatgattgggtccaacgcctctgacaggatgggaatgggcgtcacctatctagctttgattgcaacatttaaaatccagccattcctggctttgggatttttcctaagaaaactgacatctagagaaaatttactgttaggagttggactggctatggcaacaacgttacaactgccagaggacattgaacaaatggcaaatggaatcgccctggggctcatggctcttaaattgataacacaatttgaaacataccaattatggacggcattaatctccttaacgtgttcaaatacaattttcacgttgactgttgcctggagaacagccaccctgattttggccggagtttcacttttaccagtgtgccagtcttcgagcatgaggaaaacagactggcttccaatgacagtggcagctatgggagtcccacccctaccactctttatttttagcttgaaagacacactcaaaaggagaagctggccactgaatgaaggggtgatggctgttgggcttgtgagcattcttgccagttctctccttagaaatgacgtacccatggctggaccattagtggccgggggcttgctgatagcgtgctacgtcataactggcacgtcagcagaccttacagtagaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaagacagcattactaatagtatcaggtatttttccatactccatacccgcaacattgttggtctggcatacttggcaaaagcaaacccaaagatccggtgttctatgggacgtacccagccccccagagacacagaaagcagaactggaagaaggggtctataggatcaaacagcaaggaattcttgggaaaacccaagtaggggttggagtacaaaaagaaggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcccgggaagaacccaaagaactttcaaaccatgccaggcacatttcagactacaacaggggaaataggagcaattgcactggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaagcgaaatctaaccataatggatcttcatcctgggtcaggaaagacacggaaataccttccagccattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaattataacttgataataatggatgaggcccatttcacagacccagccagtatagcggccagagggtacatatcaactcgtgttggaatgggagaggcagccgcaattttcatgagtgcaacgccccctggaacagctgatgcctttcctcagagcaatgctccaattcaagatgaagaaagggacataccagaacgctcatggaattcaggcaatgaatggattaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgattgggactttgtggtgacaactgacatttcagaaatgggggccaatttcaaagcagatagagtgatcgacccaagaagatgtctaaaaccagtgatcctgacagatggaccagagcgggtgatcttggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacatcaacactccagaaggaatcataccagctctctttgaaccagaaagggagaagtcagccgccatagacggtgaatatcgcctgaagggtgaatccaggaagactttcgtggaactcatgaggaggggtgaccttccagtttggttagcccacaaagtagcatcagaagggatcaaatatacagataggaaatggtgctttgatggacagcgcaacaatcaaattttagaggaaaacatggacgtggaaatctggacaaaggaaggagaaaagaaaaaattgagacctaggtggcttgatgcccgcacttattcagatcccttagcactcaaggaattcaaggactttgcggctggcagaaagtcaattgcccttgatcttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgcttttcttgatatcaggtaaagggattggaaagacttcaataggactcatttgtgtgattgcttccagcggcatgctgtggatggccgaaatcccactccaatggatcgcgtcggctatagtcctggagttttttatgatggtgttgcttataccagaaccagaaaagcagagaaccccccaagacaaccaactcgcatatgtcgtaataggcatacttacattggctgcaataatagcggccaatgaaatgggactgttggaaactacaaagagagatttaggaatgtctaaggagcccggtgttgtttctccaactagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttttgctaattacacattatgctattataggtccaggactgcaggcaaaagccactcgtgaagctcaaaaaaggacagctgctggaataatgaagaatccaacggtggatgggataataacgatagacctagatcctgtaatatacgattcaaaatttgaaaagcaactgggacaggtcatgctcctggttttgtgtgcagttcaactgttgttaatgagaacatcatgggccttgtgtgaagctttaactttagctacaggaccaataacaacactctgggaaggatcacctgggaagttttggaataccacgatagctgtttccatggcgaacatttttagagggagctatttagcaggagctgggcttgccttttctattatgaaatcagttggaacaggaaaaagaggaacaggctctcaaggtgaaactttaggagaaaaatggaaaaagaaattgaatcaattatcccggaaagagtttgacctttacaagaagtctggaatcactgaagtggatagaacagaagccaaagaagggttgaaaagaggagaaacaacacatcatgccgtgtctagaggtagtgcaaaacttcaatggttagtggagagaaacatggtcattcccgaaggaagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctgaaaaacaaccagttttgcattaaagtattgaacccttacatgccagccgtgattgagcacctagaaagactacaaaggaaacacggaggaatgcttgtgagaaatccactttcacgaaactccacgcacgaaatgtactggatatctaatggtacaggtaacattgtctcttcagtcaacatggtatccagattgttactgaacaggttcacgatgacacacaggagacctaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaagccacaggctcagcctcctccatgataaatggagtcgtgaaacttctcactaaaccatgggatgtggtgcccatggtgacacagatggcaatgacagatacaactccatttggccagcagagagtctttaaagagaaagtggacaccaggacacccaggcctatgccagggacaagaaaggttatggagatcacagcggagtggctctggagaaccctgggaaggaacaaaagacccaggttatgcacaagggaagagtttacaaaaaaggtcagaaccaacgcagccatgggcgccgttttcacagaggagaaccaatgggacagtgcgaaagctgctgttgaggatgaagagttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggatccaggtaccttgagttcgaagcccttggattcttaaatgaagaccactggttctcgcgtgaaaactcttacagtggagtagaaggagaaggactgcacaagctaggctacatattaagggatatctccaagatacccggaggagccatgtatgctgatgacacagctggttgggacacaagaataacagaagatgacctgcacaatgaggaaaagatcacacagcaaatggaccctgaacacaggctgttagcgaacgctatattcaagctcacataccaaaacaaagtggtcaaagttcaacgaccgactccaacgggcacggtaatggacatcatatctaggaaagaccaaaggggcagtggacaggtgggaacttatggtctgaatacatttaccaacatggaagcccagttagtcagacaaatggaaggagaaggtgtgctgtcaaaggcagacctcgagaaccctcatctgccagaaaagaaaattacacaatggttggaaaccaaaggagtggagaggttaaaaagaatggccattagcggggatgattgcgtagtgaaaccaattgatgacaggttcgctaacgccctgcttgctctgaacgatatgggaaaggttcggaaagacatacctcaatggcagccatcaaagggatggcatgactggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgcccaaatgtggagtctcatgtattttcacagaagagatctcagactagcgtccaatgccatatgttcagcagtaccagtccactgggtccccacaagtagaacgacatggtctattcatgctcaccatcagtggatgaccacagaagacatgcttactgtttggaacagggtgtggatcgaggacaatccatggatggaagacaaaactccagttacaacctgggaaaatgttccatacctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagattcaggaaggaggaggagtcggagggagccatttggtaa

SEQ ID NO: 7730 - RNA, 9873 nt, synthetic construct
  misc_feature 1..9873: note = derived and/or modified CDS sequence (wt) from DENV-3__HQ235027__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaaaacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcatccagggttcaccatactagccctatttcttgcccattacataggcacatctttgacccagaaggtggttatttttatactactaatgctggtcaccccatccatgacaatgagatgtgtgggagtaggaaacagggattttgtggaaggtctatcaggagctacgtgggttgacgtggtgctcgagcacggggggtgtgtgactaccatggccaagaacaagccaacgttggatatagagctccagaagaccgaggctacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaacgaaacgcagggagtcacggctgagataacacctcaggcatcaaccactgaagccatcttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccatagaaatccaaaactcaggaggcacaagtatttttgcggggcacttaaaatgtagacttaagatggacaaattggaactcaaggggatgagctacgcaatgtgcacgaaaacctttgtgttgaagaaagaagtctcagaaacgcagcatgggacaatactcattaaggtcgagtacaaaggggaagatgcaccttgcaagattcctttctccacagaggatggacaagggaaagcctacaatggcagactgattacagccaacccagtggtgactaagaaggacgagcctgtcaatattgaggctgaacctccttttggggaaagtaatatagtgattggaattggagacaatgccttgaaaatcaactggtataagaaaggaagctctattgggaagatgtttgaggccactgccagaggtgcaaggcgcatggccatcttgggagacacagcctgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacatatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccagagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacgacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttggtctcagcaggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgaacaaacaggagtgtcccacaacttaatgatcacagttgatgatgatggaacaatgagaataaaagatgatgagactgagaatatcctaacagtacttttgaaaacagcattactagtagtgtcaggagtctttccatactccatacccgcaacattgctggtctggcatacttggcaaaagcaaacccaaagatccggcgttctatgggacgtgcccagccccccagagacacagaaagcagaactggaagaaggggtctataggatcaagcagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatttgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgttagcggaatagcgcaaacgaatgcagaaccagatggaccgacaccagaattggaagaggagatgttcaaaaagcgaaatctaaccataatggatcttcatcctgggtcaggaaagacacggaaataccttccagctattgttagagaggcaatcaagagacgtttgagaactctaattttggcaccgacaagggtggttgcagctgagatggaagaagcattgaaaggcctcccaataaggtaccaaacaacagcaacaaaatctgaacacacaggaagagagattgttgatctaatgtgccacgcaacgttcacaatgcgtttgctgtcaccagttagggttccaaactataacttgataataatggatgaagcccatttcacagacccagccagtatagcggctagagggtacatatcaactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaagactaaactgaatgattgggacttcgtggtgacaactgacatttcagaaatgggggccaatttcaaagcagatagagtgatcgacccaagaagatgtctcaaaccagtaatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacattaatacaccagaagggatcataccagctctctttgagccagaaagggagaagtcagccgccatagacggtgagtaccgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgctcgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacatcagaacatggcggtagggcctacaggcatgcggtggaggaactaccagagacaatggaaacactcctactcttgggactcatgatcttgttgacaggtggggcaatgcttttcttaatatcaggtaaagggattggaaagacctcaataggactcatttgtgtgattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatactcacattggctgcaataatagcagccaatgaaatgggattgctggaaactacaaagagagatttaggaatgtctaaggagccaggtgttgtctctccaaccagctatttagacgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgcgaagctcagaaaaggacagctgctggaattatgaagaatccaacggtggatgggataatgacaatagacctagatcctgtaatatatgattcaaaatttgaaaagcaactgggacaggttatgctcctggttttgtgtgcagttcaacttttgttgatgagaacatcatgggccttgtgtgaagctttaactctagctacaggaccaataacaacactctgggaaggatcacctgggaagttttggaacaccacgatagctgtttccatggcgaacatctttagagggagctatttggcaggagctgggcttgctttttctattatgaaatcagttggaacaggaaaaagaggaacaggctcacaaggtgaaactttaggagaaaaatggaaaaagaaactaaatcaactatcccggaaagagtttgaccgttacaagaaatctggaatcactgaagtggatagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaaatattgaacccttacatgccaactgtgattgagcacctagagagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacatagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcagagtggctctggagaaccctgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaaaatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggagaccaaaggagtggagaggctaaaaagaatggccattagcggggatgattgcgtagtgaaaccaatcgatgacagattcgctaatgccctgcttgctctgaacgatatgggaaaggttcggaaagacataccccaatggcagccatcaaagggatggcatgactggcaacaggttcctttctgctcccaccactttcatgaattgatcatgaaagatggaagaaagttggtggttccctgcagaccccaggacgaactaataggaagagcaagaatctcccaaggagcgggatggagcctcagagaaaccgcatgtctggggaaagcctacgctcaaatgtggagtctcatgtattttcacagaagagacctcagactagcatctaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgtggatcacttattggtctcacttccagagcaacctgggcccagaacatacccacagcaatccaacaggtgagaagccttataggcaatgaagagtttctggactacatgccttcaatgaagagatttaggaaggaggaggagtcggagggagccatttggtaa

SEQ ID NO: 7731 - RNA, 9873 nt, synthetic construct
  misc_feature 1..9873: note = derived and/or modified CDS sequence (wt) from DENV-3__JQ920476__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccctgacccagaaagtggttattttcatactactaatgctggtcaccccatccatgacaatgagatgtgtgggagtgggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaaaaattaccaatgtaacaaccgactcaaggtgtcccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgctcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagttcttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttaaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaaatgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaaacacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgctcaaacacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgatcttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagtggtatgttatggatggctgatgttccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaatcaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgcgcagttcaacttttgttaatgagaacatcatgggctttttgtgaagctctaaccctagccacaggaccaataacaacactttgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagctcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacctagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactctcacagtggagtagaaggagaaggactgcataaactgggatacatcttaagagacatttccaagatacccggaggagctatgtatgctgatgacacagctggttgggacacaagaataacagaagatgacctgcacaatgaggaaaaaatcacacagcaaatggaccctgaacataggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggctgacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7732 - RNA, 9873 nt, synthetic construct
  misc_feature 1..9873: note = derived and/or modified CDS sequence (wt) from DENV-3__JQ920477__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccctgacccagaaagtggttattttcatactactaatgctggtcaccccatccatgacaatgagatgtgtgggagtgggaaacagagattttgtggaaggcctatcaggagctacgtgggttgacgtggtgctcgagcacggtgggtgtgtgaccactatggctaagaacaagcccacgttggatatagagctccagaagaccgaggccacccaactggcgaccctaaggaaactatgtattgagggaaaaattaccaatgtaacaaccgactcaaggtgtcccacccaaggggaagcgattttacctgaggagcaggaccagaactacgtgtgtaagcacacatacgtggacagaggctggggaaacggttgtggtttgtttggcaagggaagcctggtaacatgcgctaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactatatctgggagctgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgccttaagagcatggaatgtgtgggaggtggaagattacgggttcggagttttcacaactaacatatggctgaaactccgagagaagtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgcgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaagacggataacttcacaatgggtgtcttgtgtttggcaatcctctttgaagaggtgatgagaggaaaatttgggaaaaaacacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaacacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggagttggagtacaaaaggaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcatttttcagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcagacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaatttccatgacagccacaccccctggaacagctgatgcttttcctcagagcaacgctccaattcaagatgaagaaagagatataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgatcttgacagacggacccgagcgcgtgatcctggcgggaccaatgccagtcaccgtagcgagcgctgcacaaaggagagggagagttggcaggaactcacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctaggactcatgatcctgttaacaggtggagcaatgcttttcttgatatcgggtaaagggattggaaagacttcaataggactcatttgtgtagttgcttccagcggtatgttatggatggctgatgttccactccaatggatcgcatcggccatagtcctggagtttttcatgatggtgttactaataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtagccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaatccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtgatatacgattcaaaatttgaaaaacaactaggacaggttatgctcctggttctgtgcgcagttcaacttttgttaatgagaacatcatgggctttttgtgaagctctaaccctagccacaggaccaataacaacactctgggaaggatcacctgggaagttctggaacaccacgatagccgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatatggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcatgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacctagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcctaaatgaagaccattggttctcgcgtgaaaactctcacagtggagtagaaggagaaggattgcataaactgggatacatcttaagagacatttccaagatacccggaggagctatgtatgctgatgacacagctggttgggacacaagaataacagaagatgacctgcacaatgaggaaaaaatcacacagcaaatggatcctgaacataggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggctgacctcgagaaccctcacctgctagagaagaaagttacacaatggttggaaacaaaaggagtggagaggttgaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgaccacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7733 - RNA, 9873 nt, synthetic construct
  misc_feature 1..9873: note = derived and/or modified CDS sequence (wt) from DENV-3__JQ920478__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcatcactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccctgacccagaaagtggttattttcatactactaatgctggtcaccccatccatgacaatgagatgtgtgggagtgggaaacagagattttgtggaaggcctatcaggagctacgtgggttgacgtggtgctcgagcacggtgggtgtgtgaccactatggctaagaacaagcccacgttggatatagagctccagaagaccgaggccacccaactggcgaccctaaggaaactatgtattgagggaaaaattaccaatgtaacaaccgactcaaggtgtcccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaagaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaacggcagactgatcacagctaacccaatagtgaccaagaaggaggagcctgtcaacatcgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactatatctgggagctgtggtgcaagctgacatggggtgtgtcataaactggaaaggcaaagaactcaaatgtggaagtggaattttcgtcactaatgaggtccatacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgccttaagagcatggaatgtgtgggaggtggaagattacgggttcggagttttcacaactaacatatggctgaaactccgagagaagtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgcgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaagacggataacttcacaatgggtgtcttgtgtttggcaatcctctttgaagaggtgatgagaggaaaatttgggaaaaaacacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttaggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattaatctccctaatgtgttcaaacacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactaaatgagggggtgatggctgttggacttgtgagcattctagccagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggagttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcatttttcagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaataccttccagctattgttagagaggcaatcaagagacgtttaaggactctaattttggcaccaacaagggtagttgcagctgagatggaagaagcattgaaagggctcccaataaggtatcagacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagatataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgattgacccaagaagatgtctcaagccagtgatcttgacagacggacccgagcgcgtgatcctggcgggaccaatgccagtcaccgtagcgagcgctgcacaaaggagagggagagtcggcaggaactcacaaaaagagaatgaccaatacatattcacgggccagccccttaataatgatgaagaccatgctcactggacagaagcaaaaatgctgttagacaacattaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttggctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgttccactccaatggatcgcgtcggccatagtcctggagtttttcatgatggtgttactaataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaatccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgcgcagttcaacttttgttaatgagaacatcatgggctttttgtgaagctctaaccctagccacaggaccaataacaacactctgggaaggatcacctgggaagttctggaacaccacgatagccgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccaggggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatatggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacttagaaagactacaaaggaaacatggaggaatgcttgtgagaaatccactctcacgaaactccacgcatgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatctggtgcccatggtgacacagatggcaatgacggacacaaccccattcggccagcaaagggtttttaaagagaaagtggacaccaggacacctagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtctacaacatgatgggcaagagagagaagaaactcggagagtttggcaaagcaaaaggcagtagagccatatggtacatgtggttgggagccaggtaccttgagttcgaagcactcggattcttaaatgaagaccattggttctcgcgtgaaaactctcacagtggagtagaaggagaaggattgcataaactgggatacatcttaagagacatttccaagatacccggaggagctatgtatgctgatgacacagctggttgggacacaagaataacagaagatgacctgcacaatgaggaaaaaatcacacagcaaatggatcctgaacataggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggctgacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgatatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgaccacagaagatatgcttactgtttggaacagggtgtggatagaggacaatccatggatggaggacaaaactccagtcacaacctgggaagacgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7734 - RNA, 9873 nt, synthetic construct
  misc_feature 1..9873: note = derived and/or modified CDS sequence (wt) from DENV-3__JQ920480__SS-prME
  source 1..9873: mol_type = other RNA
acatcgctctgtctcatgatgatgttaccagcaacacttgctttccatttaacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcatcactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccctgacccagaaagtggttattttcatactactaatgctggtcaccccatccatgacaatgagatgtgtgggagtgggaaacagagattttgtggaaggcctatcaggagctacgtgggttgacgtggtgctcgagcacggtgggtgtgtgaccactatggctaagaacaagcccacgttggatatagagctccagaagaccgaggccacccaactggcgaccctaaggaaactatgcattgaaggaaaaattaccaatgtaacaaccgactcaaggtgtcccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgattatggaacccttgggctagaatgttcaccacggacaggtctagatttcaatgaaatgattttgttgacaatgaagaacaaagcatggatggtacatagacaatggtttcttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaacggcagactgatcacagctaacccaatagtgaccaagaaggaggagcctgtcaacatcgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactatatctgggagctgtggtgcaagctgacatggggtgtgtcataaactggaaaggcaaagaactcaaatgtggaagtggaatttttgtcactaatgaggttcacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgccttaagagcatggaatgtgtgggaggtggaagattacgggttcggagttttcacaactaacatatggctgaaactccgagagaagtacacccaactatgtgaccacaggctaatgtcggcagccgttaaggatgagagggccgtacacgccgacatgggctattggatagaaagccaaaagaatgaaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggatatcacacccaaacggcaggaccctggcacttaggaaaattggagctggacttcaactattgcgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaagacggataacttcacaatgggtgtcttgtgtttggcaatcctctttgaagaggtgatgagaggaaaatttgggaaaaaacacatgattgcaggggctctcttcatgtttgtgctccttctctcagggcaaataacatggagagacatggtgcacacactcataatgattgggtccaacgcctctgacagaatgggaatgggcgtcacttacctagcattgattgcaacatttaaaattcagccatttttggctttaggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattaatctccctaatgtgttcaaacacaattttcacgttgactgttgcctggagaacagccaccctgattttggctgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactaaatgagggggtgatggctgttggacttgtgagcattctagccagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggagttggagtacaaaaagaaggagtttttcacaccatgtggcacgtcacaagaggagcagtgttgacacacaatgggaaaagactggaaccaaactgggctaacgtgaaaaaagatctgatttcgtacggaggaggatggaaattgagtgcacaatggcaaaaaggagaggaagtgcaggttattgctgtagagcctgggaagaacccaaagaactttcaaaccatgccaggcatttttcagacaacaacaggggagataggagcgattgcactggacttcaagcctggaacttcaggatctcctatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcagacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagatataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagaccaaactgaatgattgggactttgtggtgacaacagacatttcagaaatgggagccaatttcaaagcagacagagtgattgacccaagaagatgtctcaagccagtgatcttgacagacggacccgagcgcgtgatcctggcgggaccaatgccagtcaccgtagcaagcgctgcacaaaggagagggagagtcggcaggaactcacaaaaagagaatgaccaatacatattcacgggccagccccttaataatgatgaagaccatgctcactggacagaagcaaaaatgctgttagacaacattaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagcccacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgttccactccaatggatcgcgtcggccatagtcctggagtttttcatgatggtgttactaataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaatccactaactctcacagcggcagtactcctgctagtcacgcattatgctatcataggcccaggattgcaggcaaaagctactcgtgaagctcaaaaaaggacagctgcaggaataatgaagaatccaacagtggatgggataatgacaatagacctagaccctgtaatatacgattcaaaatttgaaaaacaactaggacaggttatgctcctggttctgtgcgcagttcaacttttgttaatgagaacatcatgggctttttgtgaagctctaaccctagccacaggaccaataacaacactctgggaaggatcacctgggaagttctggaacaccacaatagccgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatatggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacttagaaagactacaaaggaaacatggaggaatgcttgtgagaaatccactctcacgaaactccacgcatgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggacacaaccccattcggccagcaaagggtttttaaagagaaagtggacaccaggacacctagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagctatatggtacatgtggttgggagccaggtaccttgagttcgaagcactcggattcttaaatgaagaccattggttctcgcgtgaaaactctcacagtggagtagaaggagaaggattgcataaactgggatacatcttaagagacatttccaagatacccggaggagctatgtatgctgatgacacagctggttgggacacaagaataacagaagatgacctgcacaatgaggaaaaaatcacacagcaaatggatcctgaacataggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggctgacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgaccacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7735 - RNA, 9873 nt, synthetic construct
  misc_feature 1..9873: note = derived and/or modified CDS sequence (wt) from DENV-3__JQ920479__SS-prME
  source 1..9873: mol_type = other RNA
acatcgctctgtctcatgatgatgttaccagcaacacttgctttccatttaacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcatcactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccctgacccagaaagtggttattttcatactactaatgctggtcaccccatccatgacaatgagatgtgtgggagtgggaaacagagattttgtggaaggcctatcaggagctacgtgggttgacgtggtgctcgagcacggtgggtgtgtgaccactatggctaagaacaagcccacgttggatatagagctccagaagaccgaggccacccaactggcgaccctaaggaaactatgcattgaaggaaaaattaccaatgtaacaaccgactcaaggtgtcccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggtttcttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaacggcagactgatcacagctaacccaatagtgaccaagaaggaggagcctgtcaacatcgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactatatctgggagctgtggtgcaagctgacatggggtgtgtcataaactggaaaggcaaagaactcaaatgtggaagtggaattttcgtcactaatgaggttcacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgccttaagagcatggaatgtgtgggaggtggaagattacgggttcggagttttcacaactaacatatggctgaaactccgagagaagtacacccaactatgtgaccacaggctaatgtcggcagccgttaaggatgagagggccgtacacgccgacatgggctattggatagaaagccaaaagaatgaaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggatatcacacccaaacggcaggaccctggcacttaggaaaattggagctggacttcaactattgcgaaggaacaacagttgtcatcacagaaaattgtgggataagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaagacggataacttcacaatgggtgtcttgtgtttggcaatcctctttgaagaggtgatgagaggaaaatttgggaaaaaacacatgattgcaggggctctcttcatgtttgtgctccttctctcagggcaaataacatggagagacatggtgcacacactcataatgattgggtccaacgcctctgacagaatgggaatgggcgtcacttacctagcattgattgcaacatttaaaattcagccatttttggctttaggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattaatctccctaatgtgttcaaacacaattttcacgttgactgttgcctggagaacagccaccctgattttggctgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactaaatgagggggtgatggctgttggacttgtgagcattctagccagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggagttggagtacaaaaagaaggagtttttcacaccatgtggcacgtcacaagaggagcagtgttgacacacaatgggaaaagactggaaccaaactgggctaacgtgaaaaaagatctgatttcgtacggaggaggatggaaattgagtgcacaatggcaaaaaggagaggaagtgcaggttattgctgtagagcctgggaagaacccaaagaactttcaaaccatgccaggcatttttcagacaacaacaggggagataggagcgattgcactggacttcaagcctggaacttcaggatctcctatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcagacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagatataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgattgacccaagaagatgtctcaagccagtgatcttgacagacggacccgagcgcgtgatcctggcgggaccaatgccagtcaccgtagcgagcgctgcacaaaggagagggagagtcggcaggaactcacaaaaagagaatgaccaatacatattcacgggccagccccttaataatgatgaagaccatgctcactggacagaagcaaaaatgctgttagacaacattaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagcccacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgttccactccaatggatcgcgtcggccatagtcctggagtttttcatgatggtgttactaataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaatccactaactctcacagcggcagtactcctgctagtcacgcattatgctatcataggcccaggattgcaggcaaaagctactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgcgcagttcaacttttgttaatgagaacatcatgggctttttgtgaagctctaaccctagccacaggaccaataacaacactctgggaaggatcacctgggaagttctggaacaccacgatagccgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattacagtgcaggactgaaaaaagttacagaagtgcgaggatacacaaaaggcggcccaggacatgaagaaccagtacctatgtctacatatggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacttagaaagactacaaaggaaacatggaggaatgcttgtgagaaatccactctcacgaaactccacgcatgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggacacaaccccattcggccagcaaagggtttttaaagagaaagtggacaccaggacacctagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagctatatggtacatgtggttgggagccaggtaccttgagttcgaagcactcggattcttaaatgaagaccattggttctcgcgtgaaaactctcacagtggagtagaaggagaaggattgcataaactgggatacatcttaagagacatttccaagatacccggaggagctatgtatgctgatgacacagctggttgggacacaagaataacagaagatgacctgcacaatgaggaaaaaatcacacagcaaatggatcctgaacataggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggctgacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgaccacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7736 - RNA, 9873 nt, synthetic construct
  misc_feature 1..9873: note = derived and/or modified CDS sequence (wt) from DENV-3__KU216208__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacctggatgtcggctgaaggagcttggagacaagttgagaaggtagagacatgggcccttaggcacccagggttcaccatactagccctatttcttgcccattacataggcacctccttgacccagaaggtggttatttttatactactaatgctggtcaccccatccatgacaatgagatgtgtgggagtgggaaacagagattttgtggaaggtctgtcaggagctacgtggattgacgtggtgctagagcacggggggtgtgtgaccaccatggctaagaacaagcccacgctggatatagagcttcagaagaccgaggccacccaactggcgactctaaggaagctatgcattgaggggaaaattaccaacataacaactgactcaagatgtcctacccaaggggaagcagttttgcctgaggagcaggaccagaactacgtgtgtaagcatgcatacgtagacagaggctgggggaacggttgtggtctgtttggcaagggaagcttggtaacatgtgcgaaatttcaatgcctggaaccgatagagggaaaagtggtgcaatatgagaacctcaaatacaccgtcatcattacagtgcacacaggagaccaacaccaggtgggaaatgaaacgcagggagtcacggctgagataacgcctcaggcatcaactactgaagctatcttgcctgaatatggaacccttgggctagaatgctcaccacggacaggtctggatttcaatgaaatgatcttactaacaatgaagaacaaagcatggatggtacacagacaatggttttttgacctacctctaccatggacatcaggagctacaacagaaacaccaacttggaacaggaaggagctccttgtgacattcaaaaatgcacatgcgaaaaaacaagaagtagttgtccttggatcgcaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgttaacattgaggctgaacctccttttggggaaagtaatatagtaattggaattggagacaatgccttgaaaatcaactggtataagaaaggaagctctattggaaaaatgttcgaggccactgccagaggtgcaaggcgcatggccatcttgggagacacagcttgggactttggatcagtgggtggtgttctgaactcattaggcaaaatggtgcaccaaatattcggaagtgcttacacagccctgttcagtggagtctcttgggtgatgaaaattggaataggtgtcctcttgacttggataggattgaattcaaagaatacatccatgtcattttcatgcattgcgataggaatcatcacactctatctgggagctgtggtacaagctgacatggggtgtgtcgtaaattggaaaggcaaagaacttaaatgtggaagtggaattttcgtcaccaacgaggtccatacctggacagagcagtacaaattccaagcggattccccaaaaagattggcgacagctattgcaggtgcttgggaaaatggagtgtgcggaattaggtcaacaaccagaatggagaatcttttgtggaagcaaatagccaatgaactgaactacatattatgggaaaacaacatcaaattaacggtagttgtgggcgacacaattggggtcttagagcaaggaaaaagaacactaacaccacaacccatggagctaaaatactcatggaaaacgtggggaaaggcaaaaatagtgacagctgagacacaaaattcctctttcataatagacgggccaaacacaccggaatgtccaagtgcctcaagagcatggaatgtgtgggaggtggaagattacgggttcggagtcttcacaaccaacatatggctgaaactccgagaggtgtacacccaaatgtgtgaccataggctaatgtcggcagccgtcaaggatgagagggccgtgcatgccgacatgggctactggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaaaattggagctggacttcaactattgtgaaggaacaacagttgtcatcacagaaaactgtgggacaagaggcccatcattgagaacgacaacagtgtcaggaaagttgatacacgaatggtgttgccgctcgtgcacacttcctcctctgcgatacatgggagaagacggctgttggtatggcatggaaatcagacccatcagtgagaaagaagagaacatggtaaagtctttagtctcagcgggaagtggaaaggtagacaacttcacaatgggtgtcttgtgtttggcaatcctctttgaagaggtgatgagaggaaaatttgggaagaaacacatgattgcaggggttttcttcacgtttgtgctcctcctctcagggcaaataacatggagagacatggcgcacacactaataatgattgggtccaacgcctctgacaggatgggaatgggcgtcacctatctagctttaattgcaacatttaaaatccagccattcctggctttgggatttttcctaagaaaactgacatctagagaaaatttactgttaggagtcggactggctatggcaacaacgttacaattgccagaggacattgaacaaatggcaaatggaatcgccctggggctcatggctcttaaattgataacacaatttgaaacataccaattatggacggcattaatctccttaacgtgttcaaatacaattttcacgttgactgttgcctggagaacagccaccctgattttggccggagtttcacttttaccagtgtgccagtcttcgagcatgaggaaaacagactggcttccaatgacagtggcagctatgggagtcccacccctaccactctttatttttagcttgaaagacacactcaaaaggagaagctggccactgaatgaaggggtgatggctgttgggcttgtgagcattctggccagttctctccttagaaatgacgtgcccatggctggaccattagtggccgggggcttgctgatagcgtgctacgtcataactggcacgtcagcagacctcacagtagaaaaagcagcagatgtaacatgggaggaagaggctgagcaaacaggagtgtcccacaacttaatgatcactgttgatgatgatggaacaatgagaataaaagatgatgagactgagaatattttaacagtgcttttgaagacagcattactaatagtatcaggtatctttccatactccatacccgcaacattgctggtctggcatacttggcaaaagcaaacccaaagatccggtgttctatgggacgtacccagccccccagagacacagaaagcagaactggaagaaggggtctataggatcaagcagcaaggaattcttgggaaaacccaagtaggggttggagtacaaaaagaaggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggagaggaggtgcaggttattgccgtagagcctgggaagaacccaaagaactttcaaaccatgccaggcacatttcagactacaacaggggaaataggagcaattgcactggatttcaagcctggaacctcagggtctcctatcataaacagagagggaaaggtagtgggactatatggcaatggagtggtcacaaagaatggcggctacgtcagcggaatagcgcaaacaaatgcagaaccagatggaccgacgccagagttggaagaagaaatgttcaaaaagcgaaatctaaccataatggatcttcatcctgggtcaggaaagacacggaaataccttccagccattgttagagaggcaatcaagagacgtttaagaactctaattttggcaccgacaagggtggttgcagctgagatggaagaagcattgaaagggctcccaataaggtaccaaacaaccgcaacaaaatctgaacacacgggaagagagattgttgatctaatgtgccacgcaacgttcacaatgcgcttgctgtcaccagttagggttccaaactataacttgataataatggatgaggcccatttcacagacccagccagtatagcggccagagggtacatatcaactcgtgttggaatgggagaggcagccgcaatttttatgacggcaacgccccctggaacagctgatgcctttcctcagagcaacgctccaattcaagatgaagaaagggacataccagaacgctcatggaattcaggcaatgaatggattaccgactttgccggaaaaacggtgtggtttgtccccagcatcaaagccggaaatgacatagcaaactgcttgcgaaagaacgggaaaaaggtcattcaacttagtaggaagacttttgaaacagaatatcagaagactaaactaaatgattgggactttgtggtgacaactgacatttcagaaatgggggccaatttcaaagcagatagagtgatcgacccaagaagatgtctaaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgttgctggataacatcaacactccagaaggaatcataccagctctctttgaaccagaaagggagaagtcagccgccatagacggtgaatatcgcctgaaaggtgaatccaggaagactttcgtagaactcatgaggaggggtgaccttccagtttggttagcctacaaagtagcatcagaagggatcaaatatacagatagaaaatggtgctttgatggacaacgcaacaatcaaattttagaggaaaacatggacgtggaaatctggacaaaggaaggagaaaagaaaaaattaagacctaggtggcttgatgcccgcacttattcagatcccttagcactcaaggaattcaaggactttgcggctggcagaaagtcgatcgcccttgatcttgtgacagaaataggaagagtgccttcacacctagcccacagaacgagaaacgctctggacaatctggtgatgctgcacacgtcagaacatggtggtagggcctacaggcatgcggtggaggaactaccagaaacaatggaaacactcctactcttgggactcatgatcttactgacaggtggagcaatgcttttcttgatatcaggtaaagggattggaaagacttcaataggactcatttgtgtgattgcttccagcggcatgctgtggatggctgaaattcctctccaatggatcgcgtcggctatagtcctggagttttttatgatggtgttgcttataccagaaccagaaaagcagagaaccccccaagacaaccaactcgcatatgtcgtaataggcatactcacattggctgcgataatagcggccaatgaaatgggactgttggaaactacaaagagagatttaggaatgtccaaggagccaggtgttgtttctccaactagctatttggatgtggacttgcacccagcatcagcttggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttttgctaattacacattatgctattataggtccaggactgcaggcaaaagccactcgtgaagctcaaaaaaggacagctgctggaataatgaagaatccaacggtggatgggataataacaatagacctagatcctgtaatatatgattcaaaatttgaaaagcaactgggacaggtcatgctcctggttttgtgcgcagttcaactgttgttaatgagaacatcatgggccttgtgtgaagctctaactttagctacaggaccaataacaacactctgggaaggatcacctgggaagttttggaataccacgatagctgtttccatggcgaacatttttagagggagctatttagcaggagctgggcttgccttttctattatgaaatcagttggaacaggaaaaagaggaacaggctctcaaggtgaaactttaggagaaaaatggaaaaagaaattgaatcagttgtcccggaaagagtttgacctttacaagaagtctggaatcactgaagtggatagaacagaagccaaagaagggttgaaaagaggagaaacaacacatcatgccgtgtcgagaggtagtgcaaaacttcaatggtttgtggagagaaacatggtcattcccgaaggaagagtcatagacctgggctgtggaagaggaggctggtcatattactgtgcaggactgaaaaaagtcacagaagtgcgagggtacacaaaaggcggtccaggacacgaagaaccagtgcctatggcaacatatggatggaacatagttaagttaatgagtggaaaggatgtgttctatcttccacctgaaaagtgtgacaccctgttgtgtgacattggagaatcctcaccaagcccaacagtggaagaaagcagaactataagagttctgaagatggttgaaccatggctgaaaaacaaccagttttgcattaaagtattgaacccttacatgccagccgtgattgagcacctagaaagactacaaaggaaacacggaggaatgcttgtgagaaatccactttcacgaaactccacgcacgaaatgtactggatatctaatggtacaggtaacattgtctcttcagtcaacatggtatccagattgttactgaacaggttcacgatgacacacaggagacctaccatagagaaagacgtggatttaggagcaggaactcgacatgtcaatgcggaaccagaaacacccaacatggatgtcattggggaaagaataaaaaggatcaaagaggagcataattcaacatggcactatgatgacgaaaacccctacaaaacgtgggcttaccacggatcttatgaagtcaaggccacaggctcagcctcctccatgataaatggagtcgtgaaacttctcactaaaccatgggatgtggtgcccatggtgacacagatggcaatgacagacacaactccatttggccagcagagagtctttaaagagaaagtggacaccaggacacccaggcctatgccagggacaagaaaggttatggagatcacagcggagtggctctggagaaccctgggaaggaacaaaagacccaggttatgcacaagggaagagttcacaaaaaaggttagaactaacgcagccatgggcgccgttttcacagaggagaaccaatgggacagtgcgaaagctgctgttgaggatgaagaattttggaaacttgtggacagagaacgtgaactccacaaactaggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttgaatgaagaccactggttctcgcgtgaaaactcttacagtggagtagaaggagaaggactgcacaaactaggctacatattaagggacatttccaagatacccggaggagccatgtatgctgatgacacagctggttgggacacaagaataacagaagatgacctgcacaatgaggaaaagatcactcagcaaatggaccctgaacacaggctgttagcgaacgccatatttaagctcacataccaaaacaaagtggtcaaagtccaacgaccgactccaacgggcacggtaatggacatcatatctaggaaagaccaaagaggcagtggacaggtgggaacttatggtctgaacacatttaccaacatggaagcccagttagtcaggcaaatggaaggagaaggtgtgctgtcaaaggcagacctcgagaaccctcatctgccagaaaagaaaatcacacaatggttggaaaccaaaggagtggagaggttaaaaagaatggccattagcggggatgattgcgtagtgaaaccaatcgatgacaggttcgctaacgccctgcttgctctgaacgatatgggaaaggttcggaaagacatacctcaatggcagccatcaaagggatggcatgactggcagcaggttcctttctgctcccaccactttcatgaattaatcatgaaagatggaagaaagttggtggttccctgcagaccccaggacgaactaataggaagagcgagaatctctcaaggagcgggatggagtcttagagaaaccgcatgtttggggaaagcctacgcccaaatgtggagtctcatgtattttcacagaagagatctcagactagcgtccaatgccatatgttcagcagtaccagtccactgggtccccacaagtagaacgacatggtctattcatgctcaccatcagtggatgaccacagaagacatgcttactgtttggaacagggtgtggatcgaggacaatccatggatggaagacaaaactccagttacaacctgggaaaatgttccatacctagggaagagagaagaccaatggtgcggatcacttattggtctcacttccagagcaacctgggcccagaacatacccacagcaattcaacaggtgagaagccttataggcaatgaagagtttctagactacatgccttcaatgaagagattcaggaaagaggaggagtcggagggagccatttggtaa

SEQ ID NO: 7737 - RNA, 9873 nt, synthetic construct
  misc_feature 1..9873: note = derived and/or modified CDS sequence (wt) from DENV-3__GU370053__SS-prME
  source 1..9873: mol_type = other RNA
acatcactctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggatttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtggcgttagctccccatgtcggcatgggattggacacacgcacccaaacctggatgtcggctgaaggagcttggagacaagtcgagaaggtagagacatgggcccttaggcacccagggtttaccatactagccctatttctcgcccattacataggcacttccttgacccagaaggtggttattttcatattattaatgttggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaagaaagctatgcattgaggggaaaattaccaacataacaactgactcaagatgtcccacccaaggggaagcggttttgcctgaggagcaggaccagaactacgtgtgtaagcatacatacgtggacagaggctgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaaccactgaagccatcttgcctgaatatggaacccttgggctagaatgctcaccacggacaggtttggatttcaatgaaatgatcttactaacaatgaagaacaaagcatggatggtacacagacaatggttctttgacctacctctaccatgggcatcaggagcaacaacagaaacaccaacctggaacaggaaggagcttcttgtgacattcaagaacgcacatgcgaaaaaacaagaagtagttgttcttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaaaaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcccgtcaatattgaggctgaacctccttttggggaaagcaatatagtaattggaattggagacaacgccttgaaaatcaactggtacaagaaggggagctcgattgggaagatgttcgaggccactgccaggggtgcaaggcgcatggccatcttgggagacacagcttgggactttggatcagtgggtggcgttctgaattcattaggcaaaatggtgcaccaaatatttggaagtgcttatacagccctgttcagtggagtctcttgggtgatgaaaattggaataggtgtcctcttgacttggatagggttgaattcaaaaaacacatccatgtcattttcatgcattgcgataggaatcattacactctatctgggagctgtggtacaagctgacatggggtgtgtcataaactggaaaggcaaagaactcaaatgcggaagcggaattttcgtcaccaatgaggtccatacctggacagagcaatacaaattccaagcagactccccaaaaagattggcaacagccattgcaggcgcttgggagaatggagtgtgtggaattaggtcaacaaccagaatggagaacctcttgtggaagcaaatagccaatgaactgaactacatattatgggaaaacaatatcaaattaacagtagttgtgggcgatacaattggggtcttagagcaagggaagagaacactaacaccacaacccatggagctaaaatactcatggaaaacgtggggaaaggcgaaaatagtgacagctgaaatacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctactggatagaaagccaaaagaatggaagttggaagctagaaaaagcatccctcatagaggtaaaaacctgcacatggccaaaatcacacactctctggagtaatggtgtgctagagagtgacatgatcatcccaaagagtctagctggtcctatctcacaacacaactacaggcccgggtaccacacccaaacggcaggaccctggcacttaggaaaattggagctggacttcaactactgtgaaggaacaacagttgtcatcacagaaagctgtggaacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggtgtcttgtgtttggcaatcctctatgaagaggtgatgagaggaaaatttgggaagaaacacatgattgcaggggttttctttacgtttgtgctccttctctcagggcaaataacatggagagacatggcgcacacactaataatgattgggtccaacgcctctgacaggatgggaatgggcgtcacctacctagctctaattgcaacatttaaaatccaaccattcttggctttgggatttttcctaagaaagctgacatctagagaaaatttattgctaggagttgggttggccatggcaacaacgttacaactgccagaggacattgaacaaatggcaaatggaatcgctctggggctcatggctcttaaactgataacacaatttgaaacataccaattgtggacggcattagtctccttaacgtgttcaaacacaatttttacgttgactgttgcctggagaacagccactctgattttggccggagtttcgcttttaccagtgtgccagtcttcaagcatgaggaaaacagattggctcccaatggcagtggcagctatgggagttccaccccttccactttttatttttagcttgaaagacacactcaaaaggagaagctggccgctgaatgagggggtgatggctgttgggcttgtgagcattctggccagttccctccttagaaatgatgtgcccatggctggaccattagtggccgggggcttgctgatagcgtgctacgtcataactggcacgtcagcagacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattattaatagtatcaggcatttttccatactccatacccgcaacattgttggtctggcacacttggcaaaaacaaacccaaagatccggcgttttatgggatgtgcccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcaaaagggggaggaggtgcaggttattgccgtagagccagggaagaacccaaagaactttcaaaccatgccaggcacttttcagactactacaggggaaataggagcaattgcactggatttcaagcctggaacttcaggatctcctatcataaatagagagggaaaggtagtgggactgtatggcaatggagtggttacaaagaatggtggctatgtcagcggaatagcgcaaacaaatgcagaaccagatggaccgacaccagagttggaagaagagatgttcaaaaagcgaaacctgaccataatggatctccatcctgggtcaggaaagacacggaaataccttccagccattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggttccaaattacaacttgatagtaatggatgaggcccatttcacagacccagccagcatagcggctagagggtacatatcaactcgtgttggaatgggagaggcagccgcaatcttcatgacagcaacaccccctggaacagctgatgcctttcctcagagcaacgctccaattcaagatgaagaaagggacataccagaacgctcatggaattcaggcaatgaatggattaccgacttcgctgggaaaacggtgtggtttgtccctagcattaaagccggaaatgacatagcaaactgcttgcgaaaaaacgggaagaaggtcattcaacttagtaggaagacttttgacacagaatatcagaagactaaactgaatgattgggactttgtggtgacgactgacatttcagaaatgggggccaatttcaaagcagatagagtgattgacccaagaagatgtctcaaaccagtgatcttgacagatggaccagagcgggtgatcctggccggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaaggaattataccagctctctttgaaccagaaagggagaagtcagccgccatagacggtgagtaccgcctgaagggtgagtccaggaagactttcgtggaactcatgaggaggggtgaccttccagtttggttagcccataaagtagcatcagaaggaatcaaatatacagatagaaaatggtgctttgatgggcaacgcaataatcaaattttagaggagaacatggatgtggaaatctggacaaaggaaggagaaaagaaaaaattgagacctaggtggcttgatgcccgcacttattcagatccattagcactcaaggaattcaaggactttgcggctggcagaaagtcaatcgcccttgatcttgtgacagaaataggaagagtgccttcacacctagcccacagaacaagaaacgctttggacaatctggtgatgctgcatacgtcagaacatggcggtagggcttacagacatgcggtggaggaactaccagaaacaatggaaacactcctactcttgggacttatgatcttgttgacaggtggagcaatgcttttcttgatatcaggtaaagggattggaaagacttcaataggactcatctgtgtaattgcttccagcggcatgttgtggatggccgaagttccactccaatggatcgcgtcggctatagtcctggagttttttatgatggtgttgctcataccagaaccagaaaagcagagaaccccccaagacaaccaacttgcatatgtcgtgataggcatacttacattggctgcaataatagcagccaatgaaatgggactgttggaaaccacaaagagagacttaggaatgtctaaggagccaggtgttgtttctccaaccagctatttggatgtggacttgcacccagcatcagcctggacattgtacgccgtggccactacagtaataacaccaatgttaagacacaccatagagaattctacagcaaatgtgtccctggcagctatagccaaccaggcagtggttctgatgggtttggacaaaggatggccaatatcaaaaatggacttgggcgtgccactactagcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacggtggatgggataatgacaatagacctagatcctgtaatatatgattcaaaatttgaaaaacaactgggacaggtcatgctcctggttttgtgcgcagtccaacttttgctaatgagaacatcatgggccttgtgtgaagctttaaccctagctacaggaccaataacaacactctgggaaggatcacctggtaagttttggaacaccacgatagctgtttccatggcgaacatttttagagggagctatctagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaaaaaatctggaatcactgaagtggatagaacagaagccaaagaagggttgaaaagaggagagacaacacatcatgccgtgtccagaggtagcgcaaaacttcaatggtttgtggaaagaaacatggtcgttcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagcggaaaggatgtgttctatctcccacctgaaaagtgtgataccctgttgtgtgacattggagaatcttcaccaagcccaacagtggaagagagtagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaacttctcactaaaccatgggatgtggtgcccatggtgacacagatggcaatgacagacacaactccatttggccagcagagagtctttaaagagaaagtggacaccaggacgcccaggcccatgccagggacaagaaaggttatggaaatcacagcggagtggctctggagaaccctgggaaggaacaaaagacccaggttatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggtaagagagagaaaaaacttggagagtttggcaaagcgaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacaggcagttagcgaacgctatattcaagctcacataccaaaacaaagtggtcaaagttcaacgaccgactccaacgggtacggtaatggatattatatctaggaaagaccaaaggggcagtggacaagtgggaacttatggcctgaacacattcaccaacatggaagcccagttagtcagacaaatggaaggagaaggtgtgctgacaaaggcagacctcgagaaccctcatctgccagagaagaaaattacacaatggttggaaaccaaaggagtggagaggttaaaaagaatggccattagcggagatgattgcgtggtgaaaccaatcgatgataggttcgctaatgctctgcttgccctgaacgatatgggaaaggttcggaaagacataccccaatggcagccatcaaggggatggcatgattggcaacaggtccctttctgctcccaccactttcatgaattgatcatgaaagatggaagaaagttagtggttccctgcagaccccaggacgaactaataggaagagcaagaatctctcaaggagcgggatggagccttagagaaactgcatgtctggggaaagcctacgcccagatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacttgggaaaatgttccatatctagggaagagagaagaccaatggtgtggatcacttattggtctcacttccagagcaacctgggcccagaacatactcacagcaattcaacaggtgagaagccttataggcaatgaagagttcctggactatatgccttcaatgaagagattcaggaaggaagaggagtcggagggagccatttggtaa

SEQ ID NO: 7738 - RNA, 9873 nt, synthetic construct
  misc_feature 1..9873: note = derived and/or modified CDS sequence (wt) from DENV-3__JQ411814__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggagcctgaagacattgactgctggtgcaaccttacatcaacatgggtgacttatggaacgtgcaatcaagctggagagcatagacgcgacaaaagatcagtggcgttagctcctcatgtcggcatgggactggacacacgcacccaaacctggatgtcggctgaaggagcttggagacaagtcgagaaggtagagacatgggccctcaggcacccagggttcaccatactagccctatttcttgcccattacataggcacttccttgacccagaaggtggttatttttatactactaatgctggtcaccccatccatgacaatgagatgtgtgggaataggaaacagagattttgtggaaggtctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggttgtggcttgtttggcaagggaagcttggtaacgtgtgcgaaatttcaatgcctggaaccaatagagggaaaagtggtgcaatatgagaacctcaaatacaccgtcatcattacagtgcacacaggagaccaacaccaggtaggaaatgaaacgcagggagtcacggctgagataacacctcaggcatcaaccactgaagccatcttgcctgaatatggaacccttgggctagaatgctcaccacggacaggtttggatttcaatgaaatgatcttactaacaatgaagaacaaagcatggatggtacatagacaatggttttttgacctacctctaccatggacatcaggagctacaacagaaacgccaacctggaacaggaaggagcttcttgtgacattcaaaaacgcacatgcgaaaaaacaagaagtagtcgtccttggatcgcaagagggagcaatgcataccgcactgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggtgttctcttgacttggatagggttgaattcaaaaaacacatccatgtcattttcatgcattgcgataggaatcattacactctatctgggagctgtggtacaagctgacatggggtgtgtcataaactggaaaggcaaagaactcaaatgtggaagtggaattttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcttgtggaagcaaatagccaatgaactgaactacatattatgggaaaacaatatcaaattaacggtagttgtgggcgatacaattggggtcttagagcaaggaaaaagaacactaacaccacaacccatggagctaaaatactcatggaaaacatggggaaaggcaaaaatagtgacagctgaaacacaaaattcctccttcataatagacgggccaaacacaccggagtgtccaagtgcctcaagagcatggaatgtgtgggaggtggaagattacgggttcggagtcttcacaaccaacatatggctgaaactccgagatgtgtacacccaactatgtgaccataggctaatgtcggcagccgtcaaggatgagagggccgtacacgccgacatgggctattggatagaaagccaaaagaatggaagttggaagctagaaaaagcatccctcatagaggtgaaaacctgcacatggccaaaatcacacactctttggagcaatggtgtgctagagagtgacatgatcatcccaaagagtctagctggtcctatttcgcaacacaactacaggcctgggtaccacacccaaacagcaggaccctggcacttaggaaaattggagctggacttcaactattgtgaaggaacaacagttgtcatcacagaaaactgtgggacaagaggcccatcattgagaacaacaacagtgtcagggaagttgatacacgaatggtgttgccgctcgtgcacacttcctcccctgcgatacatgggagaagacggctgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcaggggttctcttcacgtttgtgctccttctctcagggcaaataacatggagagacatggcgcacacactaataatgattgggtccaacgcctctgacaggatgggaatgggcgtcacctacctagctttaattgcaacatttaaaatccagccattcttggctttgggatttttcctaagaaaactgacatctagagaaaatttattgttaggagttgggctggctatggcaacaacgttacaactgccagaggacattgaacaaatggcaaatggaatcgctctggggctcatggctcttaaactgataacacaatttgaaacataccaattatggacggcattagtctccttaacgtgttcaaatacaattcttacgttgactgttgcctggagaacagccaccctgattttggccggagtttcgcttttaccagtgtgccagtcttcgagcatgaggaaaacagactggcttccaatgacagtggcagctatgggagttccacccctaccactttttatttttagcttgaaagacacactcaaaaggagaagctggccactgaatgaaggggtgatggctgttgggcttgtgagcattctggccagttctctccttagaaatgatgtgcccatggctggaccattagtggccgggggcttgctgatagcgtgctacgtcataactggcacgtcagcagacctcactgtggaaaaagcagcagatgtaacatgggaggaagaggctgagcaaacaggagtgtcccacaacttaatgatcacagttgatgatgatggaacaatgagaataaaagatgatgagactgagaacatcctaacagtgcttttaaaaacagcattactaatagtatcaggcatctttccatactccatacccgcaacattgttggtctggcatacttggcaaaagcaaacccaaaggtccggcgttctgtgggacgtacccagccccccagagacacagaaagcagaactggaagaaggggtttataggatcaaacagcaaggaattcttgggaaaacccaagtaggggttggagtacagaaagaaggagtcttccacaccatgtggcacgtcacaagaggggcagtgttgacacataatgggaaaagactggaaccaaactgggctagcgtgaaaaaagatctgatttcatacggaggaggatggagattgagcgcgcaatggcaaaagggggaggaggtgcaggttattgccgtggagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacaaatgcagaaccagatggaccgacaccagagttggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcttgctgtcaccagttagggttccaaattataacttgataataatggatgaggcccatttcacagacccagccagcatagcggctagagggtacatatcaactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggattaccgacttcgctgggaaaacggtgtggtttgtccccagcattaaagccggaaatgacatagcaaactgcttgcggaaaaacgggaaaaaggtcattcaacttagtaggaagacttttgacacagaatatcagaagactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagaggaagagttggcaggaacccacaaaaagaaaatgaccagtacatattcacgggccagcctctcaacaatgatgaagaccatgctcactggacagaagcaaaaatgctgctggacaacattaacacaccagaagggattataccagctctctttgaaccagaaagggagaagtcagccgccatagacggtgagtatcgcctgaagggtgagtccaggaagactttcgtggaactcatgaggaggggtgaccttccagtttggttagcccataaagtagcatcagaagggatcaaatatacagatagaaaatggtgctttgatggacaacgcaataatcaaattttagaggagaacatggatgtggaaatctggacaaaggaaggagaaaagaaaaaattgagacctaggtggcttgatgcccgcacttattcagatcccttagcactcaaggaatttaaggactttgcggctggcagaaagtcaatcgcccttgatcttgtgacagaaataggaagagtgccttcacacctagcccacagaacgagaaacgctctggacaatctggtgatgctgcatacgtcagaacatggcggtagggcctacaggcatgcggtggaggaactaccagaaacaatggaaacactcttactcttgggactcatgatcttgttgacaggtggagcaatgcttttcttgatatcaggaaaagggattggaaagacttcaataggactcatttgtgtaattgcctccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggactgttggaaactacaaagagagatttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccactgactctaacagcggcagtacttttgctaatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctggaaagttttggaacaccacgatagctgtttccatggcgaacatttttagagggagctatttagcaggagctgggcttgctttttctattatgaaatcagttggaacaggaaaaagaggaacaggttcacaaggcgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatactactgtgcaggactgaaaaaagtcacagaagtgcgaggatacacaaaaggcggtccaggacacgaagaaccagtacctatgtctacatatggatggaacatagttaagttaatgagtggaaaggatgtgttttatcttccacctgaaaagtgtgataccctgttgtgtgacatcggagaatcttcaccaagcccaacagtggaagaaagcagaactataagagttttgaagatggttgaaccatggctaaaaaacaaccagttttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtatctagattgctactgaacaggttcacgatgacacacaggagacctaccatagagaaagatgtggatttaggagcaggaactcgacatgttaatgcggaaccagaaacacccaacatggatgtcattggggaaagaataaaaaggatcaaggaggagcacaattcaacatggcactatgatgacgaaaacccctacaaaacgtgggcttaccatggatcctatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggcccatgccagggacaagaaaggttatggggatcacagcggagtggctctggagaaccctgggaaggaacaaaagacccaggttatgcacaagggaagagtttacaaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgacaactcttacagtggagtagaaggagaaggactgcacaagctaggctacatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacgggcacggtaatggacatcatatctaggaaagaccaaagaggcagtggacaggtgggaacttatggtctgaatacattcaccaacatggaagtccagttagtcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgtgtagtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttagtggttccctgtagaccccaggacgaactaataggaagagcaagaatctctcaaggagcgggatggagccttagagagaccgcatgtctggggaaagcctacgctcaaatgtggagtctcatgtactttcacagaagagatctcagactagcatccaacgccatatgttcagcagtaccagtccactgggtccccacaagtagaacgacatggtctattcatgctcaccatcagtggatgactacagaagacatgcttactgtctggaacagggtgtggatcgaggacaatccatggatggaagacaaaactccagttacaacctgggaaaatgttccatatctagggaagagagaagaccaatggtgcggatcacttattggtctcacctccagagcaacctgggcccagaacatacccacagcaattcaacaggtgagaagccttataggcaatgaagagtttctggattacatgccttcaatgaagagattcaggaaggaggaggagtcggaaggagccatttggtaa

SEQ ID NO: 7739 - RNA, 9873 nt, synthetic construct
  misc_feature 1..9873: note = derived and/or modified CDS sequence (wt) from DENV-3__KM190937__SS-prME
  source 1..9873: mol_type = other RNA
acatcgctctgtctcatgatgatgttaccagcaacacttgctttccacttaacttcacgagatggagagccgcgcatgattgtggggaagaatgaaagaggaaaatccctacttttcaagacagcctctggaatcaacatgtgcacactcatagctatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgatagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaatgcagggagtcacggctgagataacaccccaggcatcaaccgctgaagtcattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagctacagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaggggatgagctatgcaatgtgcttgagtagctttgtgttgaagaaagaagtctccgaaacgcagcatgggacaatactcattaaggttgagtacaaaggggaagatgcaccctgcaagattcctttctccacggaggatggacaaggaaaagctcacaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcagactcccccaagagactggcaacagccattgcaggcgcttgggaaaatggagtgtgcggaattaggtcaacaaccagaatggagaacctcttgtggaagcaaatagccaatgaactgaattacatattatgggaaaacaacattaaattaacggtagttgtaggcgacataactggggtcttagagcaagggaaaagaacactaacaccacaacccatggagctaaaatattcttggaaaacatggggaaaggcaaaaatagtgacagctgaaacacaaaattcctctttcataatagatgggccaagcacaccggagtgtccaagtgcctcaagagcatggaatgtgtgggaggtggaggattacgggttcggagttttcacaaccaacatatggctgaaactccgagaggtgtacacccaactatgtgaccataggctaatgtcggcagccgtcaaggatgagagggctgtacatgccgacatgggctattggatagaaagccaaaagaatgggagttggaagctagaaaaagcatccttcatagaggtgaaaacctgcacatggccaaaatcacacactctctggagcaatggtgtgctagagagtgacatgattatcccaaagagtctagctggtcccatttcgcaacacaaccacaggcccgggtaccacacccaaacggcaggaccctggcacttaggaaaattggagctggacttcaactattgtgaaggaacaacagttgtcatctcagaaaactgtgggacaagaggcccatcattgagaacaacaacggtgtcagggaagttgatacacgaatggtgctgccgctcgtgcacacttcctcccctacgatacatgggagaagacggctgctggtatggcatggaaatcagacccattaatgagaaagaagagaatatggtaaagtctctagcctcagcagggagtggaaaggtggacaacttcacaatgggtgtcttgtgtttggcaatcctctttgaagaggtgatgagaggaaaatttgggaaaatacacatgattgcaggggttctcttcacgtttgtgctcctcctctcagggcaaataacatggagagacatggcgcacacactcataatgattgggtccaacgcctctgacagaatggggatgggcgtcacttacctagctctaattgcaacatttaaaattcagccattcctggctttgggattcttcctgaggaaactgacatctagagaaaatttattgctgggagttgggttggccatggcagcaacgttacgactgccagaggacattgaacagatggcgaatggaattgctttggggctcatggctcttaaactgataacacaatttgaaacataccaactatggacggcattagtttccctaacgtgttcaaatacaattttcacgttgactgttgcctggagaacagccactctgattttagccggaatttcgcttttgccagtgtgccagtcttcgagcatgaggaaaacagattggctcccaatgactgtggcagctatgggagctcaacccctaccactttttattttcagtctgaaagatacactcaaaaggagaagctggccactgaatgagggggtgatggcagttggacttgtgagcattctagctagttctctccttaggaatgatgtgcctatggctggaccattagtggctgggggcttgctgatagcgtgctacgtcataactggcacgtcagcagacctcactgtagaaaaagcagcagatgtaacatgggaggaagaggccgagcaaacaggagtgtcccacaatttaatggtcacagttgatgatgatggaacaatgagaataaaagatgacgagactgagaacatcttaacagtgcttttaaaaacagcactactaatagtatcaggcatctttccatactccatacccgcaacactgttggtctggcatacttggcaaaagcaaacccaaagatccggcgtcctatgggacgtacccagccccccagagacacagaaagcggaactggaagaaggggtctataggatcaaacagcaaggaatttttgggaaaacccaagtgggggttggagtacagaaagaaggagttttccacaccatgtggcatgtcacaagaggggcagtgttgacacacaatgggaaaagactggaaccaaactgggctagcgtgaaaaaagatctgatttcatacggaggaggatggagattgagtgcacaatggcaaaagggggaggaggtgcaggttattgccgtagagcctgggaagaacccaaagaactttcaaaccatgccaggcatttttcagacaacaacaggggaaataggagcaattgcactggatttcaagcctggaacttcaggatctcccatcataaacagagagggaaaggtagtgggactgtatggcaatggagtggttacaaagaatggaggctatgtcagtggaatagcgcaaacaaatgcagaaccagatggaccgacaccagagttggaagaagagatgttcaaaaagcgaaatctaaccataatggatctccatcctgggtcaggaaagacgcggaaatatcttccagctattgttagagaggcaatcaagagacgcttaaggactctaattttggcaccaacaagggtagttgcagctgagatggaagaagcattgaaagggctcccaataaggtatcaaacaactgcaacaaaatctgaacacacaggaagagagattgttgatctaatgtgtcacgcaacgttcacaatgcgcttgctgtcaccagtcagggttccaaactacaacttgataataatggatgaggcccatttcacagacccagccagtatagcggctagagggtacatatcaactcgtgtaggaatgggagaggcagccgcaattttcatgacagcaacaccccctggaacagctgatgcctttcctcagagcaacgctccaattcaagatgaagagagagacataccggaacgctcatggaattcaggcaatgaatggattactgactttgttgggaagacagtgtggtttgtccctagcatcaaagccggaaatgacatagcaaactgcttgcggaaaaatggaaaaaaggttattcaactcagcaggaagacctttgacacagaatatcaaaagaccaaactgaatgattgggactttgtggtgacaacagacatttcagaaatgggagccaatttcaaagcagatagagtgatcgacccaagaagatgtctcaagccggtgattttgacagatggacccgagcgggtgatcctggctggaccaatgccagtcaccgtagcgagcgctgcgcaaaggagagggagagttggcaggaacccacaaaaagaaaatgaccagtacatattcatgggccagcctctcaacaatgatgaagaccatgctcactggacagaagcaaaaatgctgctggacaacatcaacacaccagaagggattataccagctctctttgaaccagaaagggagaagtcagccgccatagacggcgaataccgcctgaagggtgagtccaggaagactttcgtggaactcatgaggaggggtgacctcccagtttggctagcccataaagtagcatcagaagggatcaaatatacagatagaaaatggtgctttgatggagaacgtaataatcaaattttagaggagaatatggatgtggaaatctggacaaaggaaggagaaaagaaaaaactgagacctaggtggcttgatgcccgcacttattcagatcctttagcactcaaagaattcaaggattttgcagctggcagaaagtcaatcgcccttgatcttgtgacagaaataggaagagtgccttcacacttagcccacagaacgagaaacgccctggataatttggtgatgctgcacacgtcagaacatggcggtagggcctacaggcatgcagtggaggaactaccagaaacgatggaaacactcttactcctgggactgatgatcttgttaacaggtggagcaatgctcttcttgatatcaggtaaagggattggaaagacttcaataggactcatttgtgtaattgcttccagcggcatgttatggatggctgatgtcccactccaatggatcgcatcggctatagtcctggagttttttatgatggtgttgctcataccagaaccagaaaagcagagaactccccaagacaaccaactcgcatatgtcgtgataggcatacttacattggctgcaatagtagcggccaatgaaatgggactgttggaaactacaaagagagatttaggaatgtctaaagaaccaggtgttgtttctccaaccagctatttggatgtggacttgcacccagcatcagcctggacattgtacgccgtggccacaacagtaataacaccaatgttgagacacaccatagagaattccacagcaaatgtgtctctggcagccatagctaaccaggcagtggtcctgatgggtttagacaaaggatggccgatatcgaaaatggacttgggcgtaccactattggcactgggttgctattcacaagtgaacccactaactcttgcagcggcagtacttttgctagtcacacattatgcaattataggtccaggattgcaggcaaaagccacccgtgaagctcagaaaaggacagctgctggaataatgaagaatccaacggtggatggaataatgacaatagacctagatcctgtaatatatgattcaaaatttgaaaagcaactaggacaggtcatgctcctggttctgtgtgcagtccaacttttattgatgagaacatcatgggccttgtgtgaagttctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaaccttaggagaaaagtggaaaaagaaattaaatcagttatcccggaaagagtttgacctttacaagaaatccggaatcaccgaagtggatagaacagaagccaaagaagggttaaaaagaggagaaataacacaccatgccgtgtccagaggcagcgcaaaacttcaatggttcgtggagagaaacatggtcattcctgaaggaagagtcatagacctaggctgtggaagaggaggctggtcatattactgtgcaggactgaaaaaagttacagaagtgcgaggatacacaaaaggcggcccaggacacgaagaaccagtacctatgtctacatacggatggaacatagtcaagttaatgagtggaaaggatgttttttatctgccacctgaaaagtgtgataccctattgtgtgacattggagaatcttcaccaagcccaacagtggaagaaagcagaaccataagagttttgaagatggttgaaccatggctaaagaacaaccagttttgcattaaagtattgaacccatacatgccaactgtgattgagcacttagaaagactacaaaggaaacatggaggaatgcttgtgagaaatccactctcacgaaactccacgcacgaaatgtattggatatccaatggtacaggcaatatcgtctcttcagtcaacatggtatccagattgctactgaacagattcacaatgacacacaggagacccaccatagagaaagatgtggatctaggagcaggaacccgacatgtcaatgcggaaccagaaacacccaacatggatgtcattggggaaagaataaaaaggatcaaagaggagcatagttcaacatggcactatgatgatgaaaatccttacaaaacgtgggcttaccatggatcctatgaagtaaaagccacaggctcagcctcctccatgataaatggagtcgtgaaactcctcacaaaaccatgggatgtggtgcccatggtgacacagatggcaatgacagatacaactccattcggccagcaaagagtttttaaagagaaagtggacaccaggacacctaggcccatgccaggaacaagaaaggttatggagatcacagcggagtggctttggaggaccctgggaaggaacaaaagacccagattatgcacaagggaggaattcacaaagaaggtcagaaccaacgcagctatgggcgctgtcttcacagaagagaaccaatgggacagtgcgagagctgctgttgaggacgaagaattttggaaacttgtggacagagaacgtgaactccacaaactgggcaagtgtggaagctgcgtttacaacatgatgggcaagagagagaaaaaacttggagagtttggtaaagcaaaaggcagtagggctatatggtacatgtggttgggagccaggtaccttgagttcgaggcgctcggattcctcaatgaagaccactggttctcgcgtgaaaactcttacagtggagtagaaggagaaggactgcacaagctgggatacatcttgagagatatttccaagatacccggaggagccatgtatgctgatgacacagccggttgggacacaagaataacagaagatgacctgcacaatgaggaaaaaatcacacagcagatggaccctgaacacaggcagctagcgaacgctatattcaagctcacataccaaaacaaagtggtcaaagtccaacgaccaactccaaagggcacggtaatggacatcatatctaggaaagaccaaagaggcagtggacaggtgggaacttatggtctgaacacattcaccaacatggaagcccagctaatcagacaaatggaaggagaaggcgtgttgtcaaaggcagacctcgagaacccccatccgctagagaagaaaattacacaatggttggaaactaaaggagtggaaaggttaaaaagaatggccatcagcggggatgattgcgttgtgaaaccaatcgacgacagattcgccaatgccctgcttgccctgaacgatatgggaaaggttagaaaggacatacctcaatggcagccatcaaagggatggcatgattggcaacaggtccccttctgctcccaccactttcatgaattgatcatgaaagatggaagaaagttggtagttccctgcagaccccaggacgaactaataggaagagcgagaatctcccaaggagcaggatggagccttagagaaactgcatgtctagggaaagcctacgctcaaatgtgggctctcatgtattttcacagaagagatcttagactagcatccaacgccatatgttcagcagtaccagtccactgggtccccacgagcagaacgacatggtctattcatgctcaccatcagtggatgactacagaagacatgcttactgtctggaacagggtgtggatagaggacaatccatggatggaagacaaaactccagtcacaacgtgggaagatgttccatatctagggaagagagaagaccaatggtgcggatcactcataggtctcacttccagagcaacctgggcccagaacatactcacagcaatccaacaggtgagaagcctcataggcaatgaagagtttctggactacatgccttcgatgaagagattcaggaaggaggaggagtcagagggagccatttggtaa

SEQ ID NO: 7740 - RNA, 9873 nt, synthetic construct
  misc_feature 1..9873: note = derived and/or modified CDS sequence (wt) from DENV-3__JQ920487__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaaaaattaccaacgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacggtagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgcacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagatacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattattaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtatatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgctagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattgtcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactctcacagtggagtagaaggagaaggactgcataaactgggatacatcttaagagatatttccaagatacccggaggagctatgtatgctgatgacacagctggttgggacacaagaataacagaagatgacctgcacaatgaggaaaaaatcacacagcaaatggatcctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgcccaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7741 - RNA, 9873 nt, synthetic construct
  misc_feature 1..9873: note = derived and/or modified CDS sequence (wt) from DENV-3__JQ920488__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcatcactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccctgacccagaaagtggttattttcatactactaatgctggtcaccccatccatgacaatgagatgtgtgggagtgggaaacagagattttgtggaaggcctatcaggagctacgtgggttgacgtggtgctcgagcacggtgggtgtgtgaccactatggctaagaacaagcccacgttggatatagagctccagaagaccgaggccacccaactggcgaccctaaggaaactatgtattgagggaaaaattaccaatgtaacaaccgactcaaggtgtcccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcgaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaacggcagactgatcacagctaacccaatagtgaccaagaaggaggagcctgtcaacatcgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttctaacctggatagggttgaattcaaaaaacacttctatgtcattttcatgcattgtgataggaatcattacactatatctgggagctgtggtgcaagctgacatggggtgtgtcataaactggaaaggcaaagaactcaaatgtggaagtggaattttcgtcactaatgaggttcacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgccttaagagcatggaatgtgtgggaggtggaagattacgggttcggagttttcacaactaacatatggctgaaactccgagagaagtacacccaactatgtgaccacaggctaatgtcggcagccgttaaggatgagagggccgtacacgccgacatgggctattggatagaaagccaaaagaatgaaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgcgaaggaacaacagttgtcatcacagaaaattgtgggataagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaagacggataacttcacaatgggtgtcttgtgtttggcaatcctctttgaagaggtgatgagaggaaaatttgggaaaaaacacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttaggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattaatctccctaatgtgttcaaacacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactaaatgagggggtgatggctgttggacttgtgagcattctagccagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggagttggagtacaaaaagaaggagtttttcacaccatgtggcacgtcacaagaggagcagtgttgacacacaatgggaaaagactggaaccaaactgggctaacgtgaaaaaagatctgatttcgtacggaggaggatggaaattgggtgcacaatggcaaaaaggagaggaagtgcaggttattgctgtagagcctgggaagaacccaaagaactttcaaaccatgccaggcatttttcagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtaccagacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagtaacgctccaattcaagatgaagaaagagatataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgattgacccaagaagatgtctcaagccagtgatcttgacagacggacccgagcgcgtgatcctggcgggaccaatgccagtcaccgtagcgagcgctgcacaaaggagagggagagtcggcaggaactcacaaaaagagaatgaccaatacatattcacgggccagccccttaataatgatgaagaccatgctcactggacagaagcaaaaatgctgttagacaacattaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgttccactccaatggatcgcgtcggccatagtcctggagtttttcatgatggtgttactaataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaatccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgcgcagttcaacttttgttaatgagaacatcatgggctttttgtgaagctctaaccctagccacaggaccaataacaacactctgggaaggatcacctgggaagttctggaacaccacgatagccgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatatggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacttagaaagactacaaaggaaacatggaggaatgcttgtgagaaatccactctcacgaaactccacgcatgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggacacaaccccattcggccagcaaagggtttttaaagagaaagtggacaccaggacacctagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactctcacagtggagtagaaggagaaggattgcataaactgggatacatcttaagagacatttccaagatacccggaggagctatgtatgctgatgacacagctggttgggacacaagaataacagaagatgacctgcacaatgaggaaaaaatcacacagcaaatggatcctgaacataggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggctgacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgaccacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7742 - RNA, 9873 nt, synthetic construct
  misc_feature 1..9873: note = derived and/or modified CDS sequence (wt) from DENV-3__JQ920489__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccctgacccagaaagtggttattttcatactactaatgctggtcaccccatccatgacaatgagatgtgtgggagtgggaaacagagattttgtggaaggcctatcaggagctacgtgggttgacgtggtgctcgagcacggtgggtgtgtgaccactatggctaagaacaagcccacgttggatatagagctccagaagaccgaggccacccaactggcgaccctaaggaaactatgtattgagggaaaaattaccaatataacaaccgactcaaggtgtcccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgagacgcaacatgggacgatactcattaaggttgagtacaaaggggaagatgcaccttgcaagattcctttctccacggaggatggacaagggaaagcccacaacggcagactgatcacagctaacccaatagtgaccaagaaggaggagcctgtcaacatcgaggcagaacctccttttggggaaagcaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactatatctgggagctgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacattaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagaagtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgcgaaggaacaacagttgtcatcacagaaaattgtgggataagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaagacggataacttcacaatgggtgtcttgtgtttggcaatcctctttgaagaggtgatgagaggaaaatttgggaaaaaacacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaagattcagccatttttggctttaggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattaatctccctaatgtgttcaaacacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactaaatgagggggtgatggctgttggacttgtgagcattctagccagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactattggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggagttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcatttttcagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcagacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagatataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgattgacccaagaagatgtctcaagccagtgatcttgacagacggacccgagcgtgtgatcctggcgggaccaatgccagtcaccgtagcgagcgctgcacaaaggagagggagagttggcaggaactcacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaagggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatttggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgttccactccaatggatcgcgtcggccatagtcctggagtttttcatgatggtgttactaataccagaaccagaaaagcagagaactccccaagacaatcaactcgcatatgtcgtgataggcatactcacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaatccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgcgcagttcaacttttgttaatgagaacatcatgggctttttgtgaagctctaaccctagccacaggaccaataacaacactctgggaaggatcacctgggaagttctggaacaccacgatagccgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaatagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtacgaggatacacaaaaggcggcccaggacatgaagaaccagtacctatgtctacatatggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacttagaaagactacaaaggaaacatggaggaatgcttgtgagaaatccactctcacgaaactccacgcatgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatgaatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggacacaaccccattcggccagcaaagggtttttaaagagaaagtggacaccaggacacctagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcctaaatgaagaccattggttctcgcgtgaaaactctcacagtggagtagaaggagaaggattgcataaactgggatacatcttaagagacatttccaagatacccggaggagctatgtatgctgatgacacagctggttgggacacaagaataacagaagatgacctgcacaatgaggaaaaaatcacacagcaaatggatcctgaacataggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggctgacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctcccaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcaatggatgaccacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7743 - RNA, 9873 nt, synthetic construct
  misc_feature 1..9873: note = derived and/or modified CDS sequence (wt) from DENV-3__KF824902__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacggcttctggaatcaacatgtgtacactcatagccatggacttaggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtagcgttagctccccatgtcggcatgggactggacacgcgcacccagacctggatgtcggctgaaggagcttggagacaagtcgagaaggtggagacatgggctcttaggcacccagggttcaccatactagctctatttctagcccattacataggcacttccctgacccagaaagtggttatttttatactactaatgctggtcactccatccatggctatgagatgcgtgggagtaggaaacagagattttgtggaaggtctgtcgggagctacatgggttgatgtggtgctcgagcacggtgggtgtgtgaccaccatggctaagaacaagcccacgctggacatagagcttcagaagaccgaggccactcaactggcgaccctaaggaaattatgcattgaggggaaaataaccaacataacaactgactcaaggtgtcctacccagggggaagcgattttacctgaggagcaggaccagaactacgtatgtaagcacacttacgtggatagaggttggggaaacggttgtggtttgtttggaaaaggaagtttggtgacatgcgcaaaatttcaatgtctagaatcaatagagggaaaagtggtgcaacatgagaacctcaaatacactgtcaccattacagtgcacacaggagaccaacaccaggtgggaaatgacacgcagggagtcacggctgagataacaccccaggcatcaaccgttgaagctatcctgcctgaatatggaacccttgggctagaatgttcaccacgcacaggtttggatttcaatgaaatgattctattgacaatgaagaataaagcatggatggtacatagacaatggttttttgacctacccctaccatggacatcaggagctacaacagagacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggaacaagcatttttgcggggcacttgaaatgcagactcaagatggacaaattggaactcaaggggatgagctatgcaatgtgcttgaatacctttgtgttaaagaaagaagtctctgaaacgcagcatgggacaatactcattaaggttgaatacaaaggggaagatgcaccttgcaagattcccttctccacagaggatggacaagggaaagcccacaatggtagactgatcacagccaacccagtggtgaccaagaaggaggagcctgtcaacattgaggctgaacctccttttggggaaagtaacatagtgatcggaattggagacaaagccttgaaaattaactggtacaagaagggaagctcgatcgggaagatgttcgaggccactgccagaggtgcaaggcgcatggccatcttgggagacacggcctgggactttggatcagtgggtggcgttctaaattcattagggaaaatggtgcaccaaatattcggaagtgcttacacagccctgtttggtggagtttcatggataatgaaaattggaataggtgtccttttaacctggatagggttgaattcaaaaaacacttccatgtcattttcatgcattgtgataggaataatcacactctatctgggaactgtggtacaagctgacatggggtgtgtcataaactggaaaggaaaagaactcaaatgtggaagtggaatcttcgtcaccaatgaggtccacacctggacagagcaatacaaatttcaagcagactcccctaaaagactggcgacggccattgcaggcgcttgggaaaatggagtttgcggaatcaggtcgacaaccagaatggagaatctattgtggaagcaaatagccaatgaactgaactacatattatgggaaaacaacatcaaattaacggtagttgtgggcgacataattggggtcttagagcaagggaaaagagcactaacaccacaacccatggagctaaaatattcatggaaaacatggggaaaggcaaaaatagtgacagctgaaatacaaaattcttctttcataatagatgggccaaacacaccggagtgtccaagtgcctcaagagcatggaatgtatgggaggtggaagattacgggtttggagttttcacaaccaatatatggctgaaactccgagaggtgtacacccaaacatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaaacacacactctttggagcaatggtgtactagagagtgacatgattatcccaaagagtctagccggtcccatttcgcaacacaaccacaggcccgggtaccacacccaaacggcaggaccctggcacttgggaaaattggagctggacttcaactattgtgaaggaacaacagtagtcatcacagaaaactgtgggacaagaggcccatcactgagaacaacaacagtgtcagggaagttgatacacgaatggtgttgccgctcgtgcacactccctcccctgcgatacatgggagaggacggctgctggtatggcatggaaattagacctatcaatgagaaagaagagaacatggtaaagtctttagtctcagcagggagtggaaaggtggacaacttcacaatgggagtcctgtgtctggcaatcctcttcgaagaggtgatgagaggaaaatttgggaaaaaacacatgattgcaggggttctcttcacgtttatgctccttctctcagggcagataacatggagagatatggctcacacactcataatgattgggtccaacgcttctgacaggatgggaatgggtgttacctacctagctttaatagcaacattcaagattcagccattcttggctttgggattctttctaaggaaattgacatccagagaaaatttgctgttgggagttggattggccatggcaacaacgctacaactgccagaggacattgaacaaatggcgaatggaattgctctggggctcatggctctaaaactgataacacaatttgagacataccagttatggacggcattagtctccctaacgtgttcaaacacaattttcacgttgactgttgcctggagaacagccaccttgattctggccggagtttcgctattgccagtgtgccagtcttcgagcatgaggaaaacagattggctcccagtggctgtggcagctatgggagttccacccttaccactttttatcttcagtttgaaagatacactcaaaaggaggagctggccactgaatgagggggtgatggctgttggccttgtgagcattctagctagttctctccttaggaatgacgtgcccatggctggaccactagtggctgggggcttgctgatagcgtgctacgtcataactggcacgtcagcagacctcactgtagaaaaagcagcagatgtaacatgggaggaagaggctgagcaaacaggagtgtcccacaatttgatgatcacagttgatgatgatggaacaatgagaataaaagatgatgagactgagaacatcctaacagtgctcttaaaaacggcattactaatagtatcaggcatctttccatactcaatacccgccacactgttggtctggcatacttggcaaaagcaaacccaaagatctggtgttctatgggatgtacccagccccccagagacacagaaagcagaactggaagagggggtctataggatcaaacaacaaggaatttttggaaaaacccaagtgggggttggagtacagaaagaaggagtcttccacaccatgtggcacgttacaagaggggcagtgttgacgcacaatgggaaaagactagaaccaaactgggccagcgtgaaaaaagacctgatttcatatggaggaggatggagattgagtgcacaatggcaaaagggagaggaggtgcaggttattgccgtagagcctgggaggaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtagttacaaaaaatggtggctacgtcagtggaatagcgcaagcaaacgcagaaccagaaggaccgacaccggaattggaagaagaaatgtttaaaaagcgaaatctaaccataatggatcttcatcctgggtcaggaaagacgcggaaatatctcccagccattgtcagagaagcaatcaagagacgcttaagaactttaattttggcaccaacaagagtggttgcagctgagatggaagaagcattgaaaggactcccaataaggtatcaaacaactgcaacaaaatctgaacacacaggaagggagattgttgtgctcatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaatcttcatgacagcaacaccccctggaacagccgaagcctttcctcagagcaacgctccaattcaagatgaagaaagggacattccggaacgctcatggaattcaggcaatgaatggattaccgactttgttgggaagacggtgtggtttgtccctagcatcaaagccggaaatgacatagcaaactgcttgcggaaaaatgggaaaaaggtcattcaactcagtaggaagacttttgacacagaatatcaaaaaaccaaactgaatgattgggacttcgtggtgacaacagacatttcagaaatgggagccaactttaaagcagatagagtgatcgacccaagaagatgtctcaagccagtgattttgacagatggacctgagcgggtgattttggctggaccaatgccagtcactgcagcgagtgctgcgcaaaggagagggagagtcggcaggaatccacaaaaagaaaatgaccagtacatattcatgggccagcctctcaacaatgacgaagaccatgctcactggacagaagcaaaaatgctgcttgacaacatcaacacaccagaagggattataccagctctctttgaaccagaaagggagaagtcagccgccatagacggtgaataccgcctgaagggtgagtccagaaagaccttcgtggaactcatgaggaggggtgaccttccagtttggctagcccacaaagtagcctcagaagggatcaaatacacagatagaaaatggtgctttgatggagaacgtaataatcaaattttagaggagaacatggacgtggaaatctggacaaaggaaggagaaaggaaaaaattgagacctaggtggcttgatgcccgcacttattcagatcccttagcactcaaagaatttaaggattttgcagctggcagaaagtcaatcgctcttgatcttgtgacagaaataggaagagtgccttcacacctagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggactcatttgtgttattgtttccagtggcatgttatggatggccgatgtcccacttcaatggatcgcgtcagctatagtcctggaatttttcatgatggtgctgctcataccagaaccagagaagcagagaactccccaagacaaccaactcgcatatgtcgtgataggcatactcacactggctgcgatagtagcagccaatgaaatgggactactggagactacaaagagagatttaggaatgtctaaagaaccaggtgttgtttctccaaccagttatttagatgtagatttgcacccagcatcagcctggacattgtacgctgtggccacaacagtaataacaccaatgttgagacataccatagagaattccacagcaaatgtgtctctggcagccatagctaaccaggcagtggtcctgatgggtttagacaaaggatggccaatatcgaaaatggacctaggtgtaccactactggcactgggctgctattcacaagtgaacccactgactctcacagcggcagtacttctgctagttacacattatgccattataggtccaggattgcaggctaaagccactcgtgaggctcaaaaaaggacagctgcaggaataatgaagaatccaacggtggatgggataatgacaatagacctagatcctgtaatatacgattcaaaatttgaaaagcaactaggacaggttatgctcctggtcctgtgtgcagttcaacttttgttaatgagaacatcatgggccttgtgtgaagctctaaccctagccacaggaccaataacaacactttgggaaggatcacctggaaagttttggaacaccacaatagctgtctccatggctaacatctttagagggagctacttagcaggagctggacttgctttttctatcatgaaatcagttggaacaggaaagagaggaacggggtcacaaggcgaaaccttaggagaaaaatggaaaaagaaattaaatcagttatcccggagagagtttgaactttacaagaaatctggaatcactgaagtggatagaacagaagccaaagaggggctgaaaagaggagaaacaacacatcatgccgtgtccagaggcagtgcaaaacttcaatggttcgtggagaggaacatggtcattcctgaaggaagagtcatagacttaggctgtggaagaggaggctggtcatattactgcgcaggactgaaaaaagttacagaagtacgaggatacacaaaaggaggcccaggacacgaagaaccagtacctatgtctacatatggatggaacacagttaagttaatgagcggaaaggatgtgttttatcttccacctgagaagtgtgataccctattgtgtgacattggagaatcttcaccaagcccaacagtggaagaaagcagaactataagagttttgaagatggttgaaccatggctaaaaaacaaccagttttgcattaaagtattaaacccttacatgccgactgtgattgaacacctagaaagactacaaagaaaacatggaggaatgcttgtgagaaacccactctcacgaaactccacgcacgagatgtactggatatccaacggtaccggcaacatcgtctcttcagtcaatatggtatccagattgctactgaacagattcacaatgacacacagaagacccaccatagagaaagacgtagatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagacacaactccatttgggcagcaaagagtctttaaagagaaagtggacaccaggacacccaggcccatgccagggacaagaaaggttatggagatcacagcggaatggctttggagaaccctgggaaggaacaaaagacccagattgtgcacaagggaagagttcacaaaaaaggtcagaaccaacgcggctatgggagccgtcttcacagaggagaaccaatgggagagtgcaagagctgctgttgaggacgaggaattctggaaacttgtgggcagagaacgtgaactccacaaattgggcaagtgtggaagctgcgtttacaacatgatgggcaagagagagaagaaacttggagagtttggcaaagcaaaaggcagcagagctatatggtacatgtggttgggagccaggtaccttgagttcgaagcactcggatttttaaatgaagaccactggttctcgcgtgaaaactcttacagtggagtagaaggagaaggactgcacaagttgggatacatcttaagagatatttccaagatacctggaggagccatgtatgctgatgacacagctggttgggacacaagaataacagaagatgacttgcacaatgaggaaaaaatcacacagcaaatggaccctgaacatagacaattagcgaacgccatatttaagctcacgtaccaaaacaaagtggtcaaagttcaacgaccaaccccaaaaggcacggtaatggacatcatatctaggaaagaccaaagaggcagtggacaggtggggacttatggtctgaacacattcaccaacatggaagcccagttaatcagacagatggagggagaaggcgtgttgtcgaaggcagacctcgagaaccctcatctgctagagaagaaaatcacacaatggttggaaaccaaaggagtggagagattaaaaagaatggccatcagcggggatgattgtgtggtgaaaccgatcgatgacaggtttgctaatgccctgcttgccctgaacgatatgggaaaggttaggaaggacatacctcaatggcagccatcaaagggctggcatgactggcaacaggtccctttctgctcccatcattttcatgaactgatcatgaaagatggaagaaagttggtggttccctgcagaccccaggacgaactaataggaagagcgagaatctctcaaggagcagggtggagcctcaaagaaactgcatgtctagggaaagcctacgctcaaatgtggagtctcatgtattttcatagaagagatcttagactagcatccaacgccatttgctcagcagtaccagtccattgggtccccacaagcagaacgacatggtctattcacgcacaccaccagtggatgaccacagaagacatgcttactgtctggaacagggtgtggatagaggacaatccatggatggaagacaaaactccagtcacaacttgggaggatgttccatacctagggaagagagaagatcaatggtgcggatcacttatcggtctcacttccagagcaacctgggcccaaaacatactcacagcaatccaacaggtgagaagccttataggcgatgaagagtttctggactacatgccctcgatgaagagattcaggaaggaggaggagtcagagggagccatttggtaa

SEQ ID NO: 7744 - RNA, 9873 nt, synthetic construct
  misc_feature 1..9873: note = derived and/or modified CDS sequence (wt) from DENV-3__KF824903__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacggcttctggaatcaacatgtgtacactcatagccatggacttaggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtagcgttagctccccatgtcggcatgggactggacacgcgcacccagacctggatgtcggctgaaggagcttggagacaagtcgagaaggtggagacatgggctcttaggcacccagggttcaccatactagctctatttctagcccattacataggcacttccctgacccagaaagtggttatttttatactactaatgctggtcactccatccatggctatgagatgcgtgggagtaggaaacagagattttgtggaaggtctgtcgggagctacatgggttgatgtggtgctcgagcacggtgggtgtgtgaccaccatggctaagaacaagcccacgctggacatagagcttcagaagaccgaggccactcaactggcgaccctaaggaaattatgcattgaggggaaaataaccaacataacaactgactcaaggtgtcctacccagggggaagcgattttacctgaggagcaggaccagaactacgtatgtaagcacacttacgtggatagaggttggggaaacggttgtggtttgtttggaaaaggaagtttggtgacatgcgcaaaatttcaatgtctagaatcaatagagggaaaagtggtgcaacatgagaacctcaaatacactgtcaccattacagtgcacacaggagaccaacaccaggtgggaaatgacacgcagggagtcacggctgagataacaccccaggcatcaaccgttgaagctatcctgcctgaatatggaacccttgggctagaatgttcaccacgcacaggtttggatttcaatgaaatgattctattgacaatgaagaataaagcatggatggtacatagacaatggttttttgacctacccctaccatggacatcaggagctacaacagagacaccaacttggaacaggaaagagcttcttgtgacattcaaaaatgcacatgcaaaaaagcaagaagtagtcgtccttggatcgcaagagggagcaatgcacacagcgctgacaggagctacagagattcaaaactcaggaggaacaagcatttttgcggggcacttgaaatgcagactcaagatggacaaattggaactcaaggggatgagctatgcaatgtgcttgaatacctttgtgttaaagaaagaagtctctgaaacgcagcatgggacaatactcattaaggttgaatacaaaggggaagatgcaccttgcaagattcccttctccacagaggatggacaagggaaagcccacaatggtagactgatcacagccaacccagtggtgaccaagaaggaggagcctgtcaacattgaggctgaacctccttttggggaaagtaacatagtgatcggaattggagacaaagccttgaaaattaactggtacaagaagggaagctcgatcgggaagatgttcgaggccactgccagaggtgcaaggcgcatggccatcttgggagacacggcctgggactttggatcagtgggtggcgttctaaattcattagggaaaatggtgcaccaaatattcggaagtgcttacacagccctgtttggtggagtttcatggataatgaaaattggaataggtgtccttttaacctggatagggttgaattcaaaaaacacttccatgtcattttcatgcattgtgataggaataatcacactctatctgggaactgtggtacaagctgacatggggtgtgtcataaactggaaaggaaaagaactcaaatgtggaagtggaatcttcgtcaccaatgaggtccacacctggacagagcaatacaaatttcaagcagactcccctaaaagactggcgacggccattgcaggcgcttgggaaaatggagtttgcggaatcaggtcgacaaccagaatggagaatctattgtggaagcaaatagccaatgaactgaactacatattatgggaaaacaacatcaaattaacggtagttgtgggcgacataattggggtcttagagcaagggaaaagagcactaacaccacaacccatggagctaaaatattcatggaaaacatggggaaaggcaaaaatagtgacagctgaaatacaaaattcttctttcataatagatgggccaaacacaccggagtgtccaagtgcctcaagagcatggaatgtgtgggaggtggaagattacgggtttggagttttcacaaccaatatatggctgaaactccgagaggtgtacacccaaacatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgattatcccaaagagtctagccggtcccatttcgcaacacaaccacaggcccgggtaccacacccaaacggcaggaccctggcacttgggaaaattggagctggacttcaactattgtgaaggaacaacagtagtcatcacagaaaactgtgggacaagaggcccatcactgagaacaacaacagtgtcagggaagttgatacacgaatggtgttgccgctcgtgcacactccctcccctgcgatacatgggagaggacggctgctggtatggcatggaaattagacctatcaatgagaaagaagagaacatggtaaagtctttagtctcagcagggagtggaaaggtggacaacttcacaatgggagtcctgtgtctggcaatcctcttcgaagaggtgatgagaggaaaatttgggaaaaaacacatgattgcaggggttctcttcacgtttatgctccttctctcagggcagataacatggagagatatggctcacacactcataatgattgggtccaacgcttctgacaggatgggaatgggtgttacctacctagctttaatagcaacattcaagattcagccattcttggctttgggattctttctaaggaaattgacatccagagaaaatttgctgttgggagttggattggccatggcaacaacgctacaactgccagaggacattgaacaaatggcgaatggaattgctctggggctcatggctctaaaactgataacacaatttgagacataccagttatggacggcattagtctccctaacgtgttcaaacacaattttcacgttgactgttgcctggagaacagccaccttgattctggccggagtttcgctattgccagtgtgccagtcttcgagcatgaggaaaacagattggctcccagtggctgtggcagctatgggagttccacccttaccactttttatcttcagtttgaaagatacactcaaaaggaggagctggccactgaatgagggggtgatggctgttggccttgtgagcattctagctagttctctccttaggaatgacgtgcccatggctggaccactagtggctgggggcttgctgatagcgtgctacgtcataactggcacgtcagcagacctcactgtagaaaaagcagcagatgtaacatgggaggaagaggctgagcaaacaggagtgtcccacaatttgatgatcacagttgatgatgatggaacaatgagaataaaagatgatgagactgagaacatcctaacagtgctcttaaaaacggcattactaatagtatcaggcatctttccatactcaatacccgccacactgttggtctggcatacttggcaaaagcaaacccaaagatctggtgttctatgggatgtacccagccccccagaaacacagaaagcagaactggaagagggggtctataggatcaaacaacaaggaatttttggaaaaacccaagtgggggttggagtacagaaagaaggagtcttccacaccatgtggcacgttacaagaggggcagtgttgacgcacaatgggaaaagactagaaccaaactgggccagcgtgaaaaaagacctgatttcatatggaggaggatggagattgagtgcacaatggcaaaagggagaggaggtgcaggttattgccgtagagcctgggaggaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtagttacaaaaaatggtggctacgtcagtggaatagcgcaagcaaacgcagaaccagaaggaccgacaccggaattggaagaagaaatgtttaaaaagcgaaatctaaccataatggatcttcatcctgggtcaggaaagacgcggaaatatctcccagccattgtcagagaagcaatcaagagacgcttaagaactttaattttggcaccaacaagagtggttgcagctgagatggaagaagcattgaaaggactcccaataaggtatcaaacaactgcaacaaaatctgaacacacaggaagggagattgttgagtgcatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaatcttcatgacagcaacaccccctggaacagccgaagcctttcctcagagcaacgctccaattcaagatgaagaaagggacattccggaacgctcatggaattcaggcaatgaatggattaccgactttgttgggaagacggtgtggtttgtccctagcatcaaagccggaaatgacatagcaaactgcttgcggaaaaatgggaaaaaggtcattcaactcagtaggaagacttttgacacagaatatcaaaaaaccaaactgaatgattgggacttcgtggtgacaacagacatttcagaaatgggagccaactttaaagcagatagagtgatcgacccaagaagatgtctcaagccagtgattttgacagatggacctgagcgggtgattttggctggaccaatgccagtcactgcagcgagtgctgcgcaaaggagagggagagtcggcaggaatccacaaaaagaaaatgatcagtacatattcacgggccagcctctcaacaatgacgaagaccatgctcactggacagaagcaaaaatgctgcttgacaacatcaacacaccagaagggattataccagctctctttgaaccagaaagggagaagtcagccgccatagacggtgaataccgcctgaagggtgagtccagaaagaccttcgtggaactcatgaggaggggtgaccttccagtttggctagcccacaaagtagcctcagaagggatcaaatacacagatagaaaatggtgctttgatggagaacgtaataatcaaattttagaggagaacatggacgtggaaatctggacaaaggaaggagaaaggaaaaaattgagacctaggtggcttgatgcccgcacttattcagatcccttagcactcaaagaatttaaggattttgcagctggcagaaagtcaatcgctcttgatcttgtgacagaaataggaagagtgccttcacacctagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggactcatttgtgttattgtttccagtggcatgttatggatggccgatgtcccacttcaatggatcgcgtcagctatagtcctggaatttttcatgatggtgctgctcataccagaaccagagaagcagagaactccccaagacaaccaactcgcatatgtcgtgataggcatactcacactggctgcgatagtagcagccaatgaaatgggactactggagactacaaagagagatttaggaatgtctaaagaaccaggtgttgtttctccaaccagttatttagatgtagatttgcacccagcatcagcctggacattgtacgctgtggccacaacagtaataacaccaatgttgagacataccatagagaattccacagcaaatgtgtctctggcagccatagctaaccaggcagtggtcctgatgggtttagacaaaggatggccaatatcgaaaatggacctaggtgtaccactactggcactgggctgctattcacaagtgaacccactgactctcacagcggcagtacttctgctagttacacattatgccattataggtccaggattgcaggctaaagccactcgtgaggctcaaaaaaggacagctgcaggaataatgaagaatccaacggtggatgggataatgacaatagacctagaccctgtaatatacgattcaaaatttgaaaagcaactaggacaggttatgctcctggtcctgtgtgcagttcaacttttgttaatgagaacatcatgggccttgtgtgaagctctaaccctagccacaggaccaataacaacactttgggaaggatcacctggaaagttttggaacaccacaatagctgtctccatggctaacatctttagagggagctacttagcaggagctggacttgctttttctatcatgaaatcagttggaacaggaaagagaggaacggggtcacaaggcgaaaccttaggagaaaaatggaaaaagaaattaaatcagttatcccggagagagtttgaactttacaagaaatctggaatcactgaagtggatagaacagaagccaaagaggggctgaaaagaggagaaacaacacatcatgccgtgtccagaggcagtgcaaaacttcaatggttcgtggagaggaacatggtcattcctgaaggaagagtcatagacttaggctgtggaagaggaggctggtcatattactgcgcaggactgaaaaaagttacagaagtacgaggatacacaaaaggaggcccaggacacgaagaaccagtacctatgtctacatatggatggaacacagttaagttaatgagcggaaaggatgtgttttatcttccacctgagaagtgtgataccctattgtgtgacattggagaatcttcaccaagcccaacagtggaagaaagcagaactataagagttttgaagatggttgaaccatggctaaaaaacaaccagttttgcattaaagtattaaacccttacatgccgactgtgattgaacacctagaaagactacaaagaaaacatggaggaatgcttgtgagaaacccactctcacgaaactccacgcacgagatgtactggatatccaacggtaccggcaacatcgtctcttcagtcaatatggtatccagattgctactgaacagattcacaatgacacacagaagacccaccatagagaaagacgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccgtgggatgtggtgcccatggtgacacagatggcaatgacagacacaactccatttgggcagcaaagagtctttaaagagaaagtggacaccaggacacccaggcccatgccagggacaagaaaggttatggagatcacagcggaatggctttggagaaccctgggaaggaacaaaagacccagattgtgcacaagggaagagttcacaaaaaaggtcagaaccaacgcggctatgggagccgtcttcacagaggagaaccaatgggagagtgcaagagctgctgttgaggacgaggaattctggaaacttgtgggcagagaacgtgaactccacaaattgggcaagtgtggaagctgcgtttacaacatgatgggcaagagagagaagaaacttggagagtttggcaaagcaaaaggcagcagagctatatggtacatgtggttgggagccaggtaccttgagttcgaagcactcggatttttaaatgaagaccactggttctcgcgtgaaaactcttacagtggagtagaaggagaaggactgcacaagttgggatacatcttaagagatatttccaagatacctggaggagccatgtatgctgatgacacagctggttgggacacaagaataacagaagatgacctgcacaatgaggaaaaaatcacacagcaaatggaccctgaacatagacaattagcgaacgccatatttaagctcacgtaccaaaacaaagtggtcaaagttcaacgaccaaccccaaaaggcacggtaatggacatcatatctaggaaagaccaaagaggcagtggacaggtggggacttatggtctgaacacattcaccaacatggaagcccagttaatcagacagatggagggagaaggcgtgttgtcgaaggcagacctcgagaaccctcatctgctagagaagaaaatcacacaatggttggaaaccaaaggagtggagagattaaaaagaatggccatcagcggggatgattgtgtggtgaaaccgatcgatgacaggtttgctaatgccctgcttgccctgaacgatatgggaaaggttaggaaggacatacctcaatggcagccatcaaagggctggcatgactggcaacaggtccctttctgctcccatcattttcatgaactgatcatgaaagatggaagaaagttggtggttccctgcagaccccaggacgaactaataggaagagcgagaatctctcaaggagcagggtggagcctcaaagaaactgcatgtctagggaaagcctacgctcaaatgtggagtctcatgtattttcatagaagagatcttagactagcatccaacgccatttgctcagcagtaccagtccattgggtccccacaagcagaacgacatggtctattcacgcacaccaccagtggatgaccacagaagacatgcttactgtctggaacagggtgtggatagaggacaatccatggatggaagacaaaactccagtcacaacttgggaggatgttccatacctagggaagagagaagatcaatggtgcggatcacttatcggtctcacttccagagcaacctgggcccaaaacatactcacagcaatccaacaggtgagaagccttataggcgatgaagagtttctggactacatgccctcgatgaagagattcaggaaggaggaggagtcagagggagccatttggtaa

SEQ ID NO: 7745 - RNA, 9873 nt, synthetic construct
  misc_feature 1..9873: note = derived and/or modified CDS sequence (wt) from DENV-3__JF504679__SS-prME
  source 1..9873: mol_type = other RNA
acatcgctctgtctcatgatgatattgccagcagcacttgctttccacttgacttcacgagatggagagccgcgcatgatcgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggccctcaggcacccagggttcactatactagccctatttcttgcccattacataggcacctccttgacccagaaggtggttatttttatactactaatgctggtcaccccatccatgacaatgagatgtgtgggagtgggaaacagggattttgtggaaggtctgtcaggagctacatgggttgacgtggtgctagagcacggggggtgtgtgaccaccatggctaagaacaagcccacgctggatatagagcttcagaagaccgaggccacccaactggcgaccctaaggaagctatgcattgaggggaaaattaccaacataacaactgactcaagatgccccacccaaggggaagcggttttgcctgaggagcaggaccagaactacgtgtgtaagcatacatacgtagacagaggctgggggaacggttgtggtttgtttggcaagggaagcttggtaacatgtgcgaaatttcaatgcctggaaccgatagagggaaaagtggtgcaatatgagaacctcaagtataccgtcatcattacagtgcacacaggagaccaacaccaggtgggaaatgaaacgcagggagtcacggctgagataacgcctcaggcatcaactactgaagccatcttgcctgaatatggaacccttgggctagagtgctcaccacggacaggtttggacttcaatgaaatgatcttactaacaatgaagaacaaagcatggatggtacacagacaatggttttttgacctacctctaccatggacatcaggagctacaacagaaacaccaacttggaacaggaaggagctccttgtgacattcaaaaatgcacatgcgaaaaaacaagaagtagttgtccttggatcacaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcggaaacgcagcatgggacaatactcattaaggtcgagtacaaaggggaagatgcaccttgcaagattcctttctccacagaggatggacaagggaaagctcacaatggcagactgatcacagccaacccagtggtgactaagaaggaggagcctgttaacattgaggctgaacctccttttggggaaagtaatatagtaattggaattggagacaatgccttgaaaatcaactggtacaagaagggaagctctattgggaagatgttcgaggctactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcctgggtgatgaaaattggaataggtgttctcttgacttggatagggttgaattcaaaaaacacatccatgtcattttcatgcattgcgataggaatcatcacactctatctgggagcagtggtacaagctgacatggggtgtgtcataaactggaaaggcaaagaacttaaatgcggaagtggaattttcgtcaccaacgaggtccatacctggacagagcagtacaaattccaagcggattccccaaaaagattggcgacagttattgcaggcgcttgggaaaatggagtgtgcggaattaggtcaacaaccagaatggagaatctcttgtggaagcagatagccaatgaactgaactacatattatgggaaaataatattaaattaacggtagttgtgggcgacacaattggggtcttggagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaaatgtgtgaccacaggctaatgtcggcagccgtcaaggatgagagggccgtgcatgccgacatgggctattggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctgtttcgcaacacaactacaggcccgggtaccacacccaaacggcaggaccctggcacttaggaaaattggagctggacttcaactattgtgaaggaacaacagttgtcatcacagaaaactgtgggacgagaggcccatcattgagaacgacaacagtgtcaggaaagttgatacacgaatggtgttgccgctcgtgcacacttcctcctctgcgatacatgggagaagacggctgttggtatggtatggaaatcagacccatcagtgagagagaagagaacatggtaaagtctttagtctcagcgggaagtggaaaggtagacaatttcacaatgggtgtcttgtgtttggcaatcctctttgaagaggtgatgagaggaaaatttgggaagaaacacatgattgcaggggttttcttcacgtttatgctccttctctcagggcaaataacatggagagacatggcgcacacactaataatgattgggtccaacgcctctgacaggatgggaatgggcgtcacctatctagctttaattgcaacatttaaaatccagccattcctggctttgggatttttcctaagaaaactgacatctagagagaatttactgttaggagttggactggctatggcaacaacgatacaactgccagaggacattgaacaaatggcaaatggaatcgccctagggctcatggctcttaaattgataacacaatttgaaacataccaattatggacggcattaatctccttaacgtgttcaaatacaattttcacgttgactgttgcctggagaacagccaccctgattttggccggagtttcacttttaccagtgtgccagtcttcgagcatgaggaaaacagactggcttccaatgacagtggcagctatgggagtcccacccctaccactctttatttttagcttgaaagacacactcaaaaggagaagctggccactgaatgaaggggtgatggctgttgggcttgtgagcattctggccagttctctccttagaaatgacgtgcccatggctggaccattagtggccgggggcttgttgatagcgtgctacgtcataactggcacgtcagcagaccttacagtagaaaaagcagcagatgtaacatgggaggaagaggctgagcaaacaggagtgtcccacaacttaatgatcacagttgatgatgatggaacaatgagaataaaagatgatgagactgagaatattctgacagtgcttttgaagacagcattactaatagtatcaggtatctttccatactccatacccgcaacattgttggtctggcatacttggcaaaagcaaacccaaagatccggtgttttatgggacgtacccagccccccagagacacagaaagcagaactggaagaaggggtctataggatcaaacagcaaggaattcttgggaaaacccaagtaggggttggagtacaaaaagaaggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacatttcagaccacaacaggggaaataggagcaattgcactggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaagcgaaatctaaccataatggatcttcatcctgggtcaggaaagacacggaaataccttccagccattgttagagaggcaatcaagagacgtttaagaactctaattttggcaccgacaagggtggttgcagctgagatggaagaagcattgaaagggctcccaataaggtaccaaacaacagcaacaaaatctgaacacacgggaagagagattgtcgatctaatgtgccacgcaacgttcacgatgcgcttgctgtcaccagttagggttccaaattacaacttgataataatggatgaggcccatttcacagacccagccagtatagcggccagagggtacatatcaactcgtgttggaatgggagaggcagccgcaattttcatgacggcaacgccccctggaacagctgatgcctttcctcagagcaacgctccaattcaagatgaagaaagggacataccagaacgctcatggaattcaggcaatgaatggattaccgacttcgccgggaaaacggtgtggtttgtccccagcatcaaagccggaaacgacatagcaaactgcttgcgaaagaacgggaaaaaggtcattcaacttagtaggaagacttttgatacagaatatcagaagactaaactaaatgattgggactttgtggtgacaactgacatttcagaaatgggggccaatttcaaagcagatagagtgatcgacccaagaagatgtctaaaaccagtgatcctgacagatggaccagagcgggtgatcctggctggaccaatgccagtcaccgtggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacatcaacactccagaaggaatcataccagctctctttgaaccagaaagggagaagtcagccgccatagacggtgaatatcgcctgaagggtgaatccaggaagactttcgtggaactcatgaggaggggtgaccttccagtttggttagctcacaaagtagcatcagaagggatcaaatacacagatagaaaatggtgctttgatggacagcgcaacaatcaaattttagaggaaaacatggacgtggaaatctggacaaaggaaggagaaaagaaaaaattaagacctaggtggcttgatgcccgcacttattcagatcccttagcactcaaggaattcaaggactttgcggctggcagaaagtcaatcgcccttgatcttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgcttttcttgatatcaggtaaagggattggaaagacttcaataggactcatttgtgtgattgcttccagcggcatgctgtggatggccgaaatcccactccaatggatcgcgtcggctatagtcctggagttttttatgatggtgttgcttataccagaaccagaaaagcagagaaccccccaagacaaccaactcgcatatgtcgtaataggcatacttacattggctgcaataatagcggccaatgaaatgggactgttggaaactacaaagagagatctaggaatgtctaaggagccaggtgttgtttctccaactagctatttggatgtggacttgcacccagcatcagcctggacattgtacgccgtggccactacagtaataacaccaatgttgagacataccatagagaattctacagcaaatgtgtccctggcagctatagccaaccaggcagtggtcctgatgggtttggacaaaggatggccaatatcaaaaatggacttaggcgtaccactactggcattgggttgctattcacaagtgaacccattgactctaacagcggcagtacttttgctagttacacattatgctattataggtccaggactgcaggcaaaagccactcgtgaagctcaaaaaaggacagctgctggaataatgaagaatccaacggtggatgggataataacaatagacctagatcctgtaatatatgattcaaaatttgaaaagcaactgggacaggtcatgctcctggttttgtgtgcagttcaactgttgttaatgagaacatcatgggccttgtgtgaagccttaactttagctacaggaccaataacaacactctgggaaggatcacctgggaagttttggaataccacgatagctgtttccatggcgaacatttttagagggagctatttagcaggagctgggcttgccttttctattatgaaatcagttggaacaggaaaaagaggaacaggctctcaaggtgaaactttgggagaaaaatggaaaaagaaactgaatcaattatcccggaaagagtttgacctttacaagaagtctggaatcactgaagtggatagaacagaagccaaagaagggttgaaaagaggagaaacaacacatcatgccgtgtccagaggtagtgcaaaacttcaatggtttgtggagagaaacatggtcattcccgaaggaagagtcatagacctgggctgtggaagaggaggctggtcatattactgtgcaggactgaaaaaagtcacagaagtgcgaggatacacaaaaggcggtccaggacacgaagaaccagtgcctatgtcaacatatggatggaacatagttaagttaatgagtggaaaggatgtgttttatcttccacctgaaaagtgtgacaccctgttgtgtgacattggagaatcctcaccaagcccaacagtggaagaaagcagaactataagagttttgaagatggttgaaccatggctgaaaaacaaccagttttgcattaaagtattgaacccttacatgccagccgtgattgagcacctagagagactacaaaggaaacacggaggaatgcttgtgagaaatccactttcacgaaactccacgcacgaaatgtactggatatctaatggtacaggtaacattgtctcttcagtcaacatggtatccagactgttactgaacaggttcacgatgacacacaggagacctaccatagagaaagatgtggatttaggagcaggaactcgacatgttaatgcggaaccagaaacacccaacatggatgtcattggggaaagaataagaaggatcaaggaggagcataattcaacatggcactatgatgacgaaaacccctacaaaacgtgggcttaccacggatcttatgaagtcaaggccacaggctcagcctcctccatgataaatggagtcgtgaaacttctcactaaaccatgggatgtggtgcccatggtgacacagatggcaatgacagatacaactccatttggccagcagagagttttcaaagagaaagtggacaccaggacacccaggcctatgccagggacaagaaaggttatggagatcacagcggagtggctctggagaaccctgggaaggaacaaaagacccaggttatgcacaagggaagagtttacaaaaaaggtcagaaccaacgcagccatgggtgccgttttcacagaggagaaccaatgggacagtgcgaaagccgctgttgaggatgaagaattttggaaacttgtggacagagaacgtgaactccacaaattgggcaagtgtggaagttgtgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgaaaactcctacagtggagtagaaggagaaggactgcacaagctaggctacatattaagggacatttccaagatacccggaggagccatgtatgctgatgacacagctggttgggacacaagaataacagaagatgacctgcacaatgaggaaaagatcacacagcaaatgaaccctgaacacaggctgttagcgaacgctatatttaagctcacataccaaaacaaagtggtcaaagttcaacgaccgactccaacgggcacggtaatggacatcatatctaggaaagaccaaagaggcagtggacaggtgggaacttatggtctaaatacatttaccaacatggaagcccagttagtcagacaaatggaaggagaaggtgtgctgtcaaaggcagacctcgagaaccctcatctgccagaaaagaaaattacacaatggttggaaaccaaaggagtggagaggttaaaaagaatggccattagcggggatgattgcgtagtgaaaccaatcgatgacaggttcgctaacgccctgcttgctctgaacgatatgggaaaggttcggaaagacatacctcaatggcagccatcaaagggatggcatgactggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctatgcccaaatgtggagtctcatgtattttcacagaagagatctcagactagcgtccaatgccatatgttcagcagtaccagtccactgggtccccacaagtagaacgacatggtctattcatgctcaccatcagtggatgactacagaagacatgcttactgtttggaacagggtgtggatcgaggacaatccatggatggaagacaaaactccagttacaacctgggaaaatgttccatacctagggaagagagaagaccaatggtgcggatcacttattggtctcacttccagagcaacctgggcccagaacatacccacagcaattcaacaggtgagaagccttataggcaatgaagagtttctggactacatgccttcaatgaagagattcaggaaggaggaggagtcggagggagccatttggtaa

SEQ ID NO: 7746 - RNA, 9873 nt, synthetic construct
  misc_feature 1..9873: note = derived and/or modified CDS sequence (wt) from DENV-3__KC425219__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcagtatgagaacctcaaatacaccgtcatcatcacagtgcacacaggagatcaacaccaggtgggaaatgaaacgcagggagtcacggctgagataacaccccaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattgacaggagccacagaaatccaaaactcaggaggcacaagtatttttgcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaatccaaaaaacacatccatgtcattttcatgcattgcgataggaatcattacactctatctgggagctgtggtgcaagctgacatgggatgtgttataaactggaaaggcaaagaactcaaatgtggatccggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctctagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccgatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctaatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagccatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacccatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtttttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaagattacacaatggttggaaaccaagggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaggcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtag

SEQ ID NO: 7747 - RNA, 9873 nt, synthetic construct
  misc_feature 1..9873: note = derived and/or modified CDS sequence (wt) from DENV-3__AY858037__SS-prME
  source 1..9873: mol_type = other RNA
acatcgctctgtctcatgatgatgttaccagtaacacttgctttccacttgacttcacgagatggagagccgcgcatgattgtggggaagaatgaaagaggaaaatccttactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggcatgggactggacacacgcgcccaaacctggatgtcggctgaaggagcttggagacaagtcgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagatttcgtggaaggtctatcaggagctacgtgggttgacgtggtgcttgaacacggtgggtgtgtgactaccatggctaagaacaagcccacgctggacatagagctccagaagaccgaggccacccaactggcaaccctaaggaaactatgtattgagggaaaaatcaccaacgtgacaaccgactcaaggtgccccacccaaggggaagcgattctacctgaggagcaggaccagaactacgtgtgtaagcacacatacgtggacagaggctggggaaacggttgtggtttgtttggcaagggaagcttggtaacatgcgcgaaatttcaatgtttggaatcaatagagggaaaagtggttcagcatgagaacctcaaatacaccgtcatcatcacagtgcacacaggagaccaacaccaggtgggaaatgaaacgcagggagtcacggctgaaataacaccccaggcatcaaccgtcgaagccatcttacctgaatatggaacccttgggctagaatgctcaccacggacaggtttggatttcaatgaaatgatcttgctgacaatgaagaacaaagcatggatggtgcatagacaatggttttttgacctacctctaccatggacatcaggggctacaacagaaacaccaacctggaataagaaagagcttcttgtgacattcaaaaacgcacacgcaaaaaaacaagaagtagtagtccttggatcgcaagagggagcaatgcacacagcactgacaggagctacagagatccaaacctcaggaggcacaagcatttttgcgggacacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtgaccaagaaggaagagcctgtcaatattgaggcagaacccccttttggggaaagtaacataataattggaattggagacagagccttgaaaatcaattggtacaagaaggggagctcgattgggaagatgttcgaggccactgccaggggtgcaaggcgcatggccatcttgggagacacagcctgggattttggatcagtaggtggtgttttaaattcactagggaaaatggtgcaccaaatatttggaagtgcttacacggccctttttagtggagtctcctggataatgaaaattggaataggtgtccttttaacttggatagggttgaattcaaaaaacacttctatgtcattttcatgcattgtgataggaatcatcacactctatttgggagccgtggtgcaagctgacatggggtgtgtcataaattggaaaggcaaagaactcaaatgtggaagtggaattttcgttactaatgaggtccacacctggacagagcaatacaaatttcaagcagactcccccaaaagactggcgacagccattgcaggcgcctgggagaatggagtatgcggaatcaggtcgacaaccagaatggagaacctcttgtggaagcaaatagccaatgaactaaactacatattatgggaaaacaacatcaaattaacggtagttgtgggtgacataattggggtcttagagcaagggaaaagaacactaacaccacaacccatggagctaaaatattcatggaaaacatggggaaaagcgaaaatagtgacagctgaaacacaaaattcctcctttataatagatgggccaaacacaccagagtgtccaaatgcctcaagagcatggaatgtgtgggaggtggaagattacgggttcggagtcttcacaactaatatatggctgaaactccgagagatgtacactcaactatgtgaccacaggctaatgtcggcagccgttaaggatgagagagccgtacacgccgacatgggctattggatagaaagccaaaagaatggtagttggaagctagaaaaggcatctctcatagaggtaaaaacctgcacatggccaaaatcacacactctctggagcaatggtgtgttggagagtgacatgatcatcccaaagagtctggctggtcctatctcgcaacacaactacaggcctggataccacacccaaacggcaggaccctggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcatgtacacttcctcccctgcgatatatgggagaagatggctgctggtatggcatggaaattagacccattaatgagaaagaagagaacatggtaaagtctttagtctcagcagggagtggaaaggtggataacttcacaatgggtgtcttgtgtcttgcaatcctcttcgaagaggtaatgagaggaaaattcgggaaaaagcacatgattgcaggggttctcttcacatttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatctagagaaaatttattattgggagttgggttggccatggcaacaacgttgcaactgccagaggacattgaacaaatggcgaatggaatagccttggggctcatggctcttaaattgataacacaatttgaaacataccaactatggacggcattagtctccctaatgtgttcaaacacaattttcacgttgactgttgcctggagaacagccaccctgattttggccggaatttcgctttttccagtgtgccagtcttcgagcatgaggaaaacagattggctcccaatgactgtggcagctatgggagttccacctttaccactttttattttcagtttgaaagacacactcaaaaggagaagctggccactgaatgagggggtgatggccgttggacttgtgagtattctagcaagttctctccttaggaatgacgtacccatggctggaccattagtggctgggggcttgctgatagcgtgctacgtcataactggcacgtcagcagacctcactgtagaaaaagcagcagatgtgacgtgggaggaagaggctgagcaaacaggagtgtcccacaatctaatgatcacagttgatgatgatggaacaatgagaataaaagatgatgagactgagaacattttaacagtgcttttgaaaacagcattactaatagtgtcaggcatttttccatactccatacctgcaacacttctggtttggcacacttggcaaaagcaaacccaaagatccggcgtcctgtgggacgtacccagccccccagagacacagaaagcagaactggaggaaggggtctataggatcaagcagcaaggaatttttggaaagacccaagtgggggttggagtacaaaaagaaggagttttccacactatgtggcacgtcacaagaggagcagtgttgacatacaatggaaaaagattggaaccaaactgggctagcgtgaaaaaagatctgatttcatacggaggaggatggagactaagtgcacaatggcaaaaaggagaagaggtgcaggttattgccgtagagcctgggaagaacccaaagaactttcaaaccatgccaggcattttccagacaacaacaggggagataggagcgattgcactggactttaagcctggaacttcaggatctcctatcataaacagagagggaaaggtagtgggactatatggcaatggagtggttacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagccatagttagagaggcaatcaagagacgcttaaggactctaattttggcaccaacaagggtggttgcagctgagatggaagaagcattgaaagggctcccaataaggtatcaaacaaccgcaacaaaatctgaacacacagggaaagagattgttgatctaatgtgccacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacggccacacctcctggaacagctgatgcctttcctcagagcaacgctccaattcaagatgaagaaagagacataccagaacgctcatggaattcaggcaatgattggattaccgactttgctggaaagactgtgtggtttgtccccagcatcaaagctgggaatgacatagcaaactgcttgcggaaaaatggaaaaaaggtcattcaacttagtaggaaaacttttgacacagaatatcaaaagactaaactaaatgattgggactttgtggtgacaacagacatttcagaaatgggagccaatttcaaagcagacagagtgatcgatccaagaagatgtctcaagccagtcattttaacggacggacccgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccacgctcactggacagaagcgaaaatgctgctagacaacatcaacacaccagaaggaatcataccagctctctttgaaccagaaagggaaaagtcagccgctatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggaaaatatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatctagcccacagaacgagaaacgctctggacaatctggtgatgttgcacacgtcagaacacggtgggagggcctacaggcatgcagtggaggaattaccagaaacaatggaaacactcttactcctgggactcatgatcctgttaacaggtggggcgatgcttttcttgatatcaggcaaaggggttggaaagacttcaataggactcatttgtgtagttgcttccagcggcatgttatggatggctgatatcccactccaatggatcgcgtcggccatagtcctggagtttttcatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttggggatgtccaaagaaccaggtgttgtttcgccaaccagctatttggatgtggatttacacccagcatcagcctggacactgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgactcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttctggaacaccacgatagctgtttccatggcgaacatctttagagggagctatctagcaggagctgggcttgctttttctatcatgaagtcagttggaacaggaaagagaggaacagggtcacaaggtgaaactttgggagaaaagtggaaaaagaaattgaatcaattatcccggaaagagtttgacctctacaagaaatccggaatcactgaagtggatagaacagaagccaaagaagggttgaaaagaggagaaataacacaccatgccgtatccagaggcagcgcaaaacttcaatggttcgtggagagaaacatggtcattcctgaaggaagagtcatagacttgggctgtggaagaggaggctggtcatattactgtgcaggattgaaaaaagttacggaagtgcgaggatacacaaaaggcggcccaggacatgaagaaccagtacctatgtctacatatggatggaacatagtcaagctgatgagtggaaaggatgtgttttatctcccacctgaaaagtgtgacactctattgtgtgacattggagaatcttcaccaagcccaacagtggaagagagcagaaccataagagtcttgaaaatggttgaaccatggctaaaaaataaccagttttgcatcaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaatatggtatccagactgctactgaacagattcacaatgacatataggagacccaccatagagaaagatgtggatttaggagcggggacccgacatgtcaatgcggaaccagaaacacccaacatggatgtcattggggaaagaataagaagaatcaaggaggagcatagttcaacatggcactatgatgatgaaaatccttacaaaacgtgggcttaccatggatcttatgaagttaaggccacaggctcagcctcctccatgataaatggagtcgtgaaactccttacgaaaccatgggatgtggtgcccacggtgacacagatggcaatgacggacacaaccccttttggccagcaaagggtttttaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacggaggagaaccaatgggacagcgctagagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatatatcttgagagatatttccaagatacctggaggagccatgtatgctgatgacacagctgggtgggatacaagaataacagaagatgacctgcacaatgaggaaaaaatcacacagcaaatggaccctgaacacaggcagttagcaaacgctatatttaagctcacataccaaaacaaagtggtcaaagtgcaacgaccaactccaaagggcacggtaatggacatcatatctaggaaagaccaaagaggcagtggacaggtgggaacttatggtttgaatacattcaccaacatggaagcccagttgatcagacaaatggaaggagaaggtgtgttgtcgaagacagacctcgagaaccctcatctgctagagaagaaaatcacacaatggttggaaactaaaggagtggagaggttaaaaagaatggccatcagcggggatgattgcgtggtgaaaccaattgacgacaggttcgccaatgccctgcttgccctaaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattgatagggagagcgagaatctctcagggagcaggatggagccttaaagaaactgcatgcctagggaaagcctacgcccaaatgtgggctctcatgtattttcacagaagagatcttagactagcatccaacgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaggaccaatggtgcggatcactcattggtctcacttccagagcaacctgggctcagaacatacttaccgcaatccaacaggtaagaagccttataggcaatgaagagtttctggactacatgccttctatgaagagattcaggaaggaggaggagtcagagggagccatttggtaa

SEQ ID NO: 7748 - RNA, 9873 nt, synthetic construct
  misc_feature 1..9873: note = derived and/or modified CDS sequence (wt) from DENV-3__KJ737429__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttatggaacgtgcaatcaagctggggagcacagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcgaaaaagcaagaagtagttgtccttggatcacaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggctgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaaatctttagtctcagcagggagtggaaaagtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggatgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtaggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgaaatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggacttatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatacttacactggctgcgatagtagcagctaatgaaatgggattactggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacattgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagacacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagtccaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7749 - RNA, 9873 nt, synthetic construct
  misc_feature 1..9873: note = derived and/or modified CDS sequence (wt) from DENV-3__DQ863638__SS-prME
  source 1..9873: mol_type = other RNA
acatcgctctgtctcatgatgatgttaccagcaacacttgctttccacttaacttcacgagatggagagccgcgcatgattgtggggaagaatgaaagaggaaaatccctactttttaagacagcttctggaatcaacatgtgcacactcatagccatggacttgggagagatgtgtgatgacacggtcacttacaaatgcccccacattgccgaagtggaacctgaagacattgactgctggtgcaaccttacatcgacatgggtgacttatggaacgtgcaatcaagctggggagcacagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagctctatttcttgcccattacataggcacttccttgacccagaaagtggttatttttatactactaatactggtcactccatccatggcaatgagatgcgtgggagtaggaaacagagattttgtggaaggtctatcgggagctacgtgggttgacgtggtgctcgagcacggtgggtgtgtgaccaccatggctaagaacaagcccacgctggacatagagcttcagaagaccgaggccacccaactggccaccctaaggaagttatgcattgagggaaaaattaccaacataacaactgactcaaggtgtcctacccagggggaagcgattttacctgaggagcaggaccagaactacgtatgtaagcatacatacgtggatagaggctggggaaacggttgtggtttgtttggaaaaggaagcttggtgacatgcgcgaaatttcaatgcttagaatcaatagagggaaaagtggtgcaacatgagaacctcaaatacactgtcatcattacagtgcacacaggagaccaacaccaggtgggaaatgaaacgcagggagtcacggctgagataacaccccaggcatcaaccgttgaagctatcttgcctgaatatggaacccttgggctagaatgctcaccacggacaggtttggatttcaatgaaatgatcttattgacaatgaagaacaaagcatggatggtacatagacaatggttctttgacctccccctaccatggacatcaggagctacaacagagacaccaacttggaacaggaaagagcttcttgtgacattcaaaaatgcacatgcaaaaaagcaagaagtagttgtccttggatcgcaagagggagcaatgcacacagcgctgacaggagctacagagatccaaaactcaggaggcacaagcatttttgccgggcacttgaaatgtagacttaagatggacaaattggaactcaaggggatgagctatgcaatgtgcttgaacacctttgtgttgaagaaagaagtctccgagacgcagcatgggacaatactcattaaggttgagtacaaaggggaagatgcaccttgcaagattcctttctccacggaggatggacaagggaaagctcacaatggtagactgatcacagccaacccagtggtgaccaagaaggaggagcctgtcaacattgaggctgaacctccttttggggaaagtaacatagtgattggaattggagacaaagccttgaaaattaactggtacaagaagggaagctcgattgggaagatgttcgaggccactgccagaggtgcaaggcgcatggccatcttgggagacacagcctgggactttggatcagtgggtggtgtcttgaattcattagggaaaatggtccaccaaatatttggaagtgcttacacagccctgtttagtggagtctcatggataatgaaaattggaataggtgtcctcttaacctggatagggttgaattcaaaaaacacttccatgtcattttcatgtattgcgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccccaaaagactggcgacagccattgcaggcgcctgggaaaatggagtctgtggaatcaggtcaacaaccagaatggagaatctattgtggaagcaaatagccaatgaactgaactacatattatgggaaaacaacatcaaattaacggtagtggtgggcgacataattggggtcttagagcaagggaaaagaacactaacaccacaacccatggagctaaaatattcatggaaaacatggggaaaagcaaaaatagtgacagctgaaacacaaaattcctctttcataatagatgggccacacacaccggagtgtccacgtgcctcaagagcatggaatgtgtgggaggtggaagattacgggtttggagtcttcacaaccaacatatggctgaaactccgagaggagtacacccaattgtgcgaccataggctaatgtcagcagccgtcaaagatgagagggccgtgcatgccgacatgggctattggatagaaagccaaaagaatggaagttggaagctagaaaaagcatccctcatagaggtaaaaacctgcacttggccaaaatcacacactctttggagtaatggtgtactagagagtgacatgatcatcccaaagagtctagctggtcctatttcgcaacacaaccacaggcccgggtaccacacccaaacggcaggaccctggcacttgggaaaattggagctggacttcaactattgtgaaggaacaacagttgtcatcacagaaaactgtgggacaagaggcccatcattgagaacaacaacagtgtcggggaagttgatacacgaatggtgttgccgctcgtgcacacttcctcccttgcgatacatgggagaagacggctgctggtatggcatggaaattagacccatcaatgagaaagaagagaacatggtaaagtctttagcctcagcagggagtggaaaggtggacaacttcacaatgggtttcctgtgtttggcaatcctcttcgaagaggtgatgagaggaaaatttgggaaaaaacacatgattgcaggggttttcctcacgtttttgctccttctctcagggcaaataacatggagagatatggcgcacacactcataatgattgggtccaacgcttctgacaggatgggaatgggcgttacctacctagctttaattgcaacatttaaaatccagccattcttggctttgggattcttcctgaggaaattgacatctagagaaaatttcctgttgggagttgggttggccatggcaacaacgttacaactgccagaggacattgaacaaatggcgaatggaattgctctggggctcatggctcttaaactgataacacaatttgagacataccagttatggacggcattagtctccctaacgtgttcaaatacaattttcacgttgactgttgcctggagaacagccaccttgattctggccggagtttcgcttttgccagtgtgccagtcttcgagcatgaggaaaacagattggctcccaatggctgtggcagctatgggagttccacccttaccacttttcatcttcagcttgaaagatacactcaaaaggagaagctggccactgaatgagggggtgatggctgttgggcttgtgagcattctagctagctctctccttaggaatgatgtgcccatggctggaccattagtggccgggggcttgctgatagcgtgctacgtcataactggcacgtcagcggacctcactgtagaaaaagcagcagatgtaacatgggaggaagaggctgagcaaacaggagtgtcccacaatttgatgatcacagttgatgatgatggaacaatgagaataaaagatgatgagactgagaacatcctaacagtgctcttaaaaacagcattactaatagtatcaggcatctttccatattccatacccgccacactgttggtctggcatacttggcaaaagcaaacccaaagatctggcgttctatgggacgtacccagccccccagaaacacagaaagcagaactggaagagggggtctataggatcaaacagcaaggaatttttgggaaaacccaagtgggggttggagtacagaaagaaggagtcttccataccatgtggcacgtcacaagaggggcagtgttgacgcacaatgggaaaagattggaaccaaactgggccagcgtgaaaaaagatctgatttcatacggaggaggatggagattgagtgcacaatggcaaaagggagaggaggtgcaggttattgccgtagagcccgggaagaacccaaagaactttcaaaccatgccgggcatttttcagacaacaacaggggaaataggagcaattgcactagacttcaagcctggaacttcaggatctcctatcataaacagagagggaaaggtagtgggactgtatggcaatggagtggttacaaagaatggtggctacgtcagtggaatagcgcaaacaaatgcagaaccagacggaccgacaccggagttggaagaggagatgttcaaaaagcgaaatctaaccataatggatcttcatcctgggtcaggaaagacgcggaaatatcttccagctatcgtcagagaagcaatcaagagacgcttaagaactctaattttggcaccaacaagggtggttgcagctgagatggaagaagcattgaaagggctcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaatcttcatgacagcaacaccccctggaacagccgatgcctttcctcagagcaacgctccaattcaagatgaagaaagggatatcccggaacgctcatggaattcaggcaatgaatggattaccgactttgttgggaagacagtgtggtttgtccccagcatcaaagccggaaatgacatagcaaactgcttgcggaaaaatggaaaaaaggtcattcaacttagtaggaagacttttgatacagaatatcaaaagaccaaactgaatgattgggacttcgtggtgacaacagacatttcagaaatgggagccaactttaaagcagatagagtgatcgacccaagaagatgtctcaagccagtgattttgacagatggacccgagcgggtgatcctggctggaccaatgccagtcactgcagcgagcgctgcgcaaaggagagggagagttggcaggaacccacaaaaagaaaatgaccagtacatattcaggggccaacctctcaacaatgacgaagaccatgctcactggacagaagcaaaaatgctgctggacaacatcaacacaccagaagggattataccagctctctttgaaccagaaagggagaagtcagccgccatagacggtgaataccgcctgaagggtgagtccaggaagaccttcgtggaactcatgaggaggggtgacctcccagtttggctagcccataaagtagcatcagaagggatcaaatatacagatagaaaatggtgctttgatggagaacgtaataatcaaattttagaggagaacatggatgtggaaatctggacaaaggaaggagaaaagaaaaaattgagacctaggtggcttgatgcccgcacttattcagatcccttggcactcaaggaattcaaggattttgcagctggcagaaagtcaatcgcccttgatcttgtgacagaaataggaagagtgccttcacatttagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgctgttcttgatatcaggtaaagggattggaaagacttcaataggactcatctgtgtaattgcttccagtggcatgttatggatggccgatgtcccacttcaatggatcgcgtcggctatagtcctggaatttttcatgatggtgttgcttataccagaaccagaaaagcagagaactccccaagacaaccaactcgcatatgtcgtgataggcatacttacactggctgcaatagtagcagccaatgaaatgggactgttggaaactacaaagagagatttaggaatgtctaaagaaccaggtgttgtttctccaaccagctatttagatgtagacttgcacccagcatcagcctggacattgtacgctgtggccacaacagtaataacaccaatgttgagacataccatagagaattccacagcaaatgtgtccctggcagctatagctaaccaggcagtggtcctgatgggcttagacaaaggatggccaatatcgaaaatggacttaggcgtaccactactggcactgggctgctattcacaagtgaacccactgactctcacagcggcagtacttttgctagctacacattatgctattataggtccaggattgcaggcaaaagccactcgtgaagctcaaaaaaggacagctgctggaataacgaagaacccaacggtggatgggataatgacaatagacctagatcctgtaatatacgattcaaaattcgaaaagcaactaggacaggttatgctcctagttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaataacacgtcatgccgtgtccagaggcagcgcaaaacttcaatggttcgtggagaggaacatggtcattcccgaaggaagagtcatagacttaggctgtggaagaggaggctggtcatattactgcgcaggattgaaaaaagttacagaagtgcgaggatacacaaaaggcggcccaggacacgaagaaccagtacctatgtctacatacggatggaacatagtcaagttaatgagtggaaaggatgtgttttatctcccacctgaaaagtgtgacaccctattgtgtgacattggagaatcttcaccaagcccaacagtggaagaaagcagaactataagagttttgaagatggttgaaccatggctaaaaaataaccagttttgcattaaagtattaaacccttacatgccaactgtgattgagcacctagaaagactacaaaggaaacatggaggaatgcttgtgagaaatccactctcacgaaactccacgcacgaaatgtactggatatccaatggtaccggcaacatcgtctcttcagtcaacatggtatccagattgctactgaacagatttacaatgacacacaggagacccaccatagagaaagatgtggatttgggagcaggaacccgacatgtcaatgcggaaccagaaacacccaatatggacgtcattggagaaagaataaaaaggatcaaggaggagcataattcaacatggcactatgatgatgaaaatccttacaaaacgtgggcttaccatggatcctatgaagtcaaagccacaggctcagcctcctccatgataaatggagtcgtgaaactcctcacaaaaccatgggatgtggtgcccatggtgatacagatggcaatgacagatacaactccatttgggcagcaaagagttttcaaagagaaagtggacaccaggacacccaggcccatgccagggacaagaaaggttatggagatcacagcggaatggctttggagaaccctgggaaggaacaaaagacccagattgtgcacaagggaagagttcacaaagaaggtcagaaccaacgcggctatgggcgccgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagccaggtaccttgagttcgaggcactcggattcttcaatgaagaccactggttctcgcgtgaaaactcttacagtggagtagaaggagaaggactgcacaagctgggatacattttaagagatatttccaagatacccggaggagctatgtatgctgatgacacagctggttgggacacaagaataacagaagatgacctgcacaatgaggaaaaaatcacacagcaaatggaccctgaacacagacagttagcgaacgccatattcaagctcacataccaaaacaaagtggtcaaagttcaacgaccaactccaaaaggcacggtaatggacatcatatctaggaaagaccaaagaggcagtggacaggtggggacttatggtctgaatacattcaccaacatggaagcccagttagtcagacagatggaaggagaaggcgtgttgtcgaaggcagaccttgagaatcctcatctgctagagaagaaaatcacacaatggttggaaaccaaaggagtggagaggttaaaaagaatggccatcagtggggatgattgcgtagtgaaaccgatcgacgacaggtttgccaatgccctgcttgccctgaacgatatgggaaaggttaggaaggacatacctcaatggcagccatcaaagggttggcatgattggcaacaggtccctttctgctcccaccactttcatgaactgatcatgaaagatggaagaaagttggtggttccctgcagaccccaggacgaactaataggaagagcgagaatctctcgaggagcaggatggagccttaaagaaactgcatgtctagggaaagcctacgctcaaatgtggagcctcatgtattttcacagaagagatcttagactagcatccaacgccatatgttcagcagtaccagtccattgggtccctacaagcagaacgacatggtctattcatgctcaccatcagtggatgactacagaagacatgcttactgtctggaacagggtgtggatagaggacaatccatggatggaagacaaaactccagtcacaacttgggaagatgttccatacctagggaagagagaagaccaatggtgcggatcactcatcggtctcacttccagagcaacctgggcccagaacatactcacagcaatccaacaagtgagaagccttataggcaatgaagagtttctggactacatgccttcgatgaagagattcaagaaggaggaggagtcagagggagccatttggtaa

SEQ ID NO: 7750 - RNA, 9873 nt, synthetic construct
  misc_feature 1..9873: note = derived and/or modified CDS sequence (wt) from DENV-3__KJ737430__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacttatggaacgtgcaatcaagctggggagcatagacgcgacaagagatcagtggcgttagctccccatgtcggcatgggactggacacacgcacccaaacctggatgtcggctgaaggagcttggagacaagtcgagaaggtagagacatgggctcttaggcacccagggttcaccatactagctctatttcttgcccattacataggcacttccctgacccagaaagtggttatttttatactactaatgctggtcactccatccatggcaatgagatgcgtgggagtaggaaacagagattttgtggaaggtctgtcgggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaatcaatagagggaaaagtggtgcaacatgagaacctcaaatacaccgtcatcatcacagtgcacacaggagaccaacaccaggtgggaaatgacacgcagggagtcacggttgagataacaccccaggcatcaaccgttgaagctatcttgcctgaatatggaacccttgggctagaatgctcaccacggacaggtttggatttcaatgaaatgattttattgacaatgaagaacaaagcatggatggtacataggcaatggttctttgacctacccctaccatggacatcaggagctacaacagagacaccaacttggaacaggaaagagcttcttgtgacattcaaaaatgcacatgcaaaaaagcaagaagtagttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagctcacaatggtagactgatcacagccaacccagtggtgaccaagaaggaggagcctgtcaacattgaggctgaacctccttttggggaaagtaacatagtgattggaattggagacaaagccttgaaaattaactggtacaagaagggaagctcgattgggaagatgttcgaggccactgccagaggtgcaaggcgcatggccatcttgggagacacagcctgggactttggatcagtgggtggtgttctaaattcattagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgcgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaagtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcgcaacacaaccacaggcccgggtaccacacccaaacggcaggaccctggcacttgggaaaattggagctggacttcaactattgtgaaggaacaacagtagtcatcacagaaaactgtgggacaagaggcccatcattgagaacaacaacagtgtcagggaagttgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaattcagccattcttggctttgggattcttcctgaggaaattgacatctagagaaaatttgctgttgggagttgggttggccatggcaacaacgttacaactgccagaggacattgaacaaatggcgaatggaattgctctggggctcatggctctaaaactgataacacaatttgagacataccagttatggacggcattagtctccctaacgtgttcaaacacaattttcacgttgactgttgcctggagaacagccaccttgattctggccggagtttcgcttttgccagtgtgccagtcttcgagcatgaggaaaacagattggctcccaatggctgtggcagctatgggagttccacccttaccactttttatcttcagcttgaaagatacactcaaaaggaggagctggccactgaatgagggggtgatggctgttgggcttgtgagcattctagctagttctctccttaggaatgatgtgcccatggctggaccactagtggccgggggcttgctgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaagatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtacagaaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactttaattttggcaccaacaagagtggttgcagctgagatggaagaagcattgaaaggactcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaacagccgaagcctttcctcagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcttgcgaaaaaatggaaaaaaggtcattcaacttagtaggaagacttttgatacagaatatcaaaagaccaaactgaatgattgggacttcgtggtgacaacagacatttcagaaatgggagccaactttaaagcagatagagtgatcgacccaagaagatgtctcaagccagtgattttgacagatggacccgagcgggtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggattataccagctctctttgaaccagaaagggagaagtcagccgctatagacggtgaataccgcctgaagggtgagtccaggaagaccttcgtggaactcatgaggaggggtgacctcccagtttggctagcccataaagtagcatcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaagcagagaactccccaagacaatcaactcgcatatgtcgtgataggcatacttacactggctgcgatagtagcagccaatgaaatgggactattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccactactggcactgggctgctattcacaagtgaacccactgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggttatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagttaatgagtggaaaggatgtgttttatcttccacctgaaaagtgtgacaccctattgtgtgacattggagaatcttcaccaagcccaacagtggaagaaagcagaactataagagttttgaagatggttgaaccatggctaaaaaacaaccagttttgcattaaagtattaaacccttacatgccaactgtgattgagcacctagaaagactacaaagaaaatatggaggaatgcttgtgagaaacccactctcacgaaactccacgcacgaaatgtactggatatccaatggtaccggcaacatcgtctcttcagtcaacatggtatccagattgctactgaacagatttacaatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggtgcccatggtgatacagatggcaatgacagatacaactccatttgggcagcaaagagttttcaaagagaaagtggacaccaggacacccaggcccatgccagggacaagaaaggttatggagatcacagcggaatggctttggagaaccctgggaaggaacaaaagacccagattgtgcacaagggaagagttcacaaaaaaggtcagaaccaacgcggctatgggagccgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagatatttccaagatacctggaggagctatgtatgctgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaagggttggcatgattggcaacaggtccctttctgctcccaccactttcatgaactgatcatgaaagatggaagaaagttggtggttccctgcagaccccaggacgaactaataggaagagcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcgatgaagagtttctggactacatgccttcgatgaagagattcaggaaggaggaggagtcagagggagccatttggtaa

SEQ ID NO: 7751 - RNA, 9873 nt, synthetic construct
  misc_feature 1..9873: note = derived and/or modified CDS sequence (wt) from DENV-3__AY858040__SS-prME
  source 1..9873: mol_type = other RNA
acatcgctctgtctcatgatgatgttaccggcaacacttgctttccacttgacttcacgagatggagagccgcgcatgattgtggggaagaatgaaagaggaaaatccctactctttaagacagcctctggaattaacatgtgcacactcatagccatggatttgggagaaatgtgtgatgacacggtcacttacaaatgccccctcattactgaagtggagcctgaagacattgactgctggtgcaacctcacatcgacatgggtgacctacggaacgtgcaaccaagctggggagcatagacgcgacaagaggtcggtggcgttagctcctcatgtcggcatgggactggacacacgcgcccaaacctggatgtcggctgaaggagcttggagacaagtcgagaaggtagagacatgggcctttaggcacccagggtttacaatactagccctatttcttgcccattacataggcacctccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgactaccatggccaagaacaagcccacgctggacatagagctccagaagaccgaggccacccaactggcaaccttaaggaaactatgcattgagggaaaaatcaccaacgtgacaaccgactcaaggtgccccacccaaggggaagcgattctacctgaggagcaggaccagaactacgtgtgtaagcacacatacgtggacagaggctggggaaacggttgtggtttgtttggcaagggaagcttggtaacatgcgcgaaatttcaatgtttggaattaatagagggaaaagtggtgcaacatgagaacctcaaatacaccgtcatcatcacagtgcacacaggagaccaacaccaggtgggaaacgaaacgcagggagtcacggctgagataacaccccaggcatcaaccgtcgaagccatcttacctgaatatggaacccttgggctagaatgctcaccacggacaggtttggatttcaatgaaatgattttgttgacaatgaaaaacaaagcatggatggtacatagacaatggttttttgacctacctctaccatggacatcaggggctacaacagaaacacctacctggaataagaaagagcttcttgtgacattcaaaaatgcacacgcaaaaaaacaagaagtagtagtccttggatcgcaagagggagcaatgcacacagcactgacaggagctacagagatccaaacctcaggaggcacaagtatttttgcggggcacttgaaatgcagactcaagatggataaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtccttttaacttggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagtggaattttcgttactaatgaggtccacacctggacagagcaatacaaatttcaagcagactcccccaaaagactggcgacagccattgcaggcgcctgggagaatggagtgtgcggaatcaggtcgacaaccagaatggagaacctcttgtggaaacaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaaatagtgacagctgaaaaacaaaattcctcctttataatagatgggccaaacacaccagagtgtccaaatgcctcaagagcatggaatgtgtgggaggtggaagattacgggttcggagtcttcacaactaatatatggctgaaactccgagagatgtacacccaactatgtgaccacaggttaatgtcggcagccgttaaggatgagagagctgtacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaagagtctggctggtcctatctcgcaacacaactacaggcccggataccacacccaaacggcaggaccctggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaatcagacccattaatgagaaagaagagaacatggtaaagtctttagtctcagcagggagtggaaaggtggacaacttcacaatgggtgtcttgtgtcttgcaatcctctttgaagaggtaatgagaggaaaattcgggaaaaagcacatgattgcaggggttctcttcacatttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcttgaggaaactgacatctagagaaaatttattattgggagttgggttggccatggcaacaacgttgcaactgccagaggacattgaacaaatggcgaatggaatagccttggggctcatggctcttaaattgataacacaatttgaaacataccaactatggacggcattagtctccctaatgtgttcaaacacaattttcacgttgactgttgcctggagaacagccaccctgattttggccggaatttcgcttatgccagtgtgccagtcttcgagcatgaggaaaacagattggctcccaatgactgtggcagctatgggagttccacctctaccactttttattttcagtttgaaagacacactcaaaaggagaagctggccactgaatgagggggtgatggccgttggacttgtgagcattctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtatcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagttttccacactatgtggcacgtcacaagaggagcagtgttgacatacaatgggaaaagactggaaccaaactgggctagcgtgaaaaaagatctgatttcatacggaggaggatggagactgagtgcatactggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggtagcagctgagatggaagaagcattgaaagggctcccagtaaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacagccacacctcctggaacagctgatgcctttcctcagagcaacgctccaattcaagatgaagaaagagacataccagaacgctcatggaattcaggcaatgattggatcaccgactttgcaggaaagactgtgtggtttgtccccagcatcaaagctgggaatgatatagcaaactgcttgcgaaaaaatggaaaaaaggtcattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcacagtagcgagtgctgcgcaaaggagagggagagttggcaggaacccacaaaaagaaaatgaccaatacatattcacgggccagccccttaacaatgacgaagaccacgctcactggacagaagcaaaaatgctgctagacaacatcaacacaccagaaggaatcataccagctctctttgaaccagaaagggagaagtcagccgccatagacggcgaataccgcccgaaaggtgagtccaggaagaccttcgtggaactcatgaggaggggtgacctcccagtttggctagcccataaagtagcatcagaaggaatcaaatacacagacagaaaatggtgctttgatggagagcgcaacaatcaaattttagaggagaatatggatgtggaaatctggacaaaggaaggagaaaagaaaaaattgaggcctaggtggcttgatgcccgcacttattcagatcccttagcgctcaaggaattcaaggactttgcggctggtagaaagtcgattgcccttgatcttgtgacagaaataggaagagtgccttcacatttagctcacagaacgagaaacgctctggacaatttggtgatgttgcacacgtcagaacacggtgggagggcctacaggcatgcagtggaggaattaccagaaacaatggaaacactcttactcctgggactcatgatcctgttaacgggtggggcgatgcttttcttgatatcaggcaaaggggttggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttagggatgtccaaagaaccaggtgttgtttcgccaaccagctatttggatgtggatttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcattgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaagaaatccggaatcactgaagtggatagaacagaagccaaagaagggttgaaaagaggagaaataacacaccatgccgtatccaggggcagcgcaaaacttcaatggttcgtggagagaaacatggtcattcctgaaggaagagttatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaagagagcagaaccataagggtcttgaaaatggttgaaccatggctaaaaaataaccagttttgcattaaagtattgaacccttacatgccaactgtgattgagcaccttgaaagactacaaaggaaacatggaggaatgcttgtgagaaatccactctcacgaaactccacgcacgaaatgtactggatatctaacggcacaggtaacatcgtctcttcagtcaacatggtatccagactgctactgaacagattcacaatgacatataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggtttttaaagagaaagtggacaccaggacacccaaacccatgccaggaacaagaaaggttatggagatcacagcggaatggctttggagaaccttgggaaggaacaaaagacccagattatgcacgagagaggagttcacaaaaaaggtcagaaccaacgcagctatgggcgccgtatttacagaggagaaccaatgggacagtgccagagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccactggttctcgcgtgaaaactcttacagtggagtagaaggggaaggattgcataagctgggatacatcttgagagatatttccaagatacccggaggagccatgtatgctgatgacacagctgggtgggacacaagaataacagaagatgacctgcacaatgaggaaaaaatcacacagcaaatggaacctgaacacaggcagttagcaaacgctatttttaagctcacataccaaaacaaagtggtcaaagttcaacgaccaactccaaagggcacggtaatggacattatatctaggaaagaccaaagaggcagtggacaggtgggaacttatggtctgaatacattcaccaacatggaagcccaattgatcagacaaatggaaggagaagatgtgttgtcgaagacagacctcgagaaccctcatctgctggagaagaaaattacacaatggttggaaaccaaaggagtggagaggttaaaaagaatggccatcagcggggatgattgcgtggtgaaaccaatcgacgacaggttcgccaatgccctgcttgccctgaatgacatgggaaaagttaggaaggacataccccaatggcagccatcgaaaggatggcatgattggcaacaagtccctttctgctcccaccactttcatgaattgattatgaaagatggaagaaagttggtagtcccctgcagacctcaggatgaattaatagggagagcgagaatctctcagggagcaggatggagccttaaagaaactgcatgtctagggaaagcctacgcccaaatgtgggccctcatgtattttcacagaagagatcttagactagcatccaatgccatatgttcagcagtaccagtccattgggtccccacaagcagaacgacgtggtccatccatgctcaccatcagtggatgactacagaagacatgcttaccgtttggaacagggtgtggatagaggacaatccatggatggaagacaaaactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaagagtcagagggagccatttggtaa

SEQ ID NO: 7752 - RNA, 9873 nt, synthetic construct
  misc_feature 1..9873: note = derived and/or modified CDS sequence (wt) from DENV-3__AY858041__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctacttttcaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgttggcatgggactggacacacgcgcccaaacctggatgtcggctgaaggagcttggagacaagtcgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgactactatggctaagaacaagcccacgctggacatagagctccagaagaccgaggccacccaactggcaaccctaaggaaactatgcattgaggggaaaatcaccaacgtgacaaccgactcaaggtgccccacccaaggggaagcgattctacctgaggagcaggaccagaactacgtgtgtaagcacacatacgtggacagaggctggggaaacggttgtggtttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtacatagacagtggtttttcgacctacctctaccatggacatcaggggctacaacagaaacaccaacctggaataagaaagagcttcttgtgacattcaaaaacgcacacgcaaaaaaacaagaagtagtagtccttggatcgcaagagggagcaatgcacacagcactgacaggagccacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggcaagcccacaatggcagactgatcacagctaacccagtggtgaccaagaaggaagagcctgtcaatattgaggcagaatctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtcctcttaacttggatagggttaaattcaaaaaacacttctatgtcattttcatgcattgtgataggaattatcacactctatctgggagccgtggtgcaagctgatatggggtgtgtcataaactggaaaggcaaagaactcaaatgtggaagtggaattttcgtcactaatgaggtccacacctggacagagcaatacaaatttcaagcagactcccccaaaagactggcgacagccattgcaggcgcctgggagaatggagtgtgcggaatcaggtcgacaaccagaatggagaacctcttgtggaagcaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaaactccgagagatgtacacccaactatgtgaccacaggctaatgtcggcagctgttaaagatgagagagccgtacacgccgacatgggctattggatagaaagccaaaagaatggtagttggaagctagaaaaggcatctctcatagaggtgaaaacctgcacatggccaaaatcacacactctctggagcaatggtgtgttagagagtgacatgatcatcccaaagagtctggctggtcctatctcgcaacacaactacaggcccggataccacacccaaacagcaggaccctggcacctaggaaaattggagctggacttcaactattgtgaaggaacaacagttgtcatcacagaaaattgtgggacaagaggcccatcactgaggacaacaacagtgtcaggaaaattgatacacgaatggtgttgccgctcgtgtacacttcctcccctgcgatatatgggagatgacggctgctggtatggcatggaaattagacccattaatgagaaagaagagaacatggtaaagtctttagtctcagcagggagtggaaaggtggataacttcacaatgggtgtcttgtgtcttgcaatcctctttgaagaggtaatgagaggaaaatttgggaaaaagcatatgattgcaggggttctcttcatgtttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatccagagaaaatttattattgggagttgggttggccatggcaacaacgttgcaactgccagaggacattgaacaaatggcgaatggaatagccctggggctcatggctcttaaattgataacacaatttgaaacataccaactatggacggcattagtctccctaacgtgttcaaatacaattttcacgttgactgttgcctggagaacagccaccttgatcttggccggaatttcgcttttgccagtgtgccagtcctcgagcatgaggaaaacagattggctcccaatgactgtggcagctatgggagttccacctctaccactttttatcttcagtttgaaagatacactcaaaaggagaagctggccactgaatgagggggtgatggccgttggacttgtgagcattctagcaagttctctccttaggaatgacgtacccatggctggaccattagtggctgggggcttgctgatagcgtgctacgttataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtacttttgaaaacagcactactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagttttccacactatgtggcacgtcacaagaggggcagtgttgacatacaatggaaaaagactggaaccaaactgggctagtgtgaaaaaagatctgatttcatacggaggaggatggagactgagtgcacaatggaaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagatggaccgacaccagagttggaagaagagatgttcaaaaagcgaaatctaaccataatggatctccatcccgggtcaggaaagacgcggaaataccttccagctatagttagagaggcaatcaaaagacgcttaaggactctaattttggcaccaactagggtggttgcagctgagatggaagaagcattgaaagggctcccaataaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacagccacaccccctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagacatttcagaaatgggagccaacttcaaagcagacagagtgatcgacccaagaagatgtctcaagccagttattttgacagacggacccgagcgcgtgatcctggcgggaccaatgccagtcaccgtagcgagtgctgcgcagaggagagggagagttggcaggaacccacaaaaagaaaatgaccaatacatattcacgggccagcccctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaacttatgaggaggggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttggcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagaacacggtgggagggcctacaggcatgcagtggaggaattaccagaaacaatggaaacactcttactcctgggactcatgatcctgttaacaggtggggcgatgctcttcttgatatcaggcaaaggggttggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttggggatgtccaaagaaccaggtgttgtctcgtcaaccagctatttggatgtggatttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgcctctgctggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaagaaatccggaatcactgaagtggatagaacagaagccaaagaagggttgaaaagaggagaaataacacaccacgccgtatccagaggcagcgcaaaacttcaatggttcgtggagagaaacatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaagaaagcagaaccataagagtcttgaaaatggttgaaccatggctaaaaaataaccagttttgcattaaagtattgaacccttatatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccttttggtcagcaaagggtttttaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaacaaggcaagtgtggaagctgcgtttacaacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgacacagctgggtgggacacaagaataacagaagatgacctgcacaacgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttaaaaaggatggccatcagcggggatgattgcgtggtgaaaccaattgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattaatagggagagcgagaatctcccagggagcaggatggagccttaaagaaactgcatgcctagggaaagcctacgcccaaatgtgggctctcatgtattttcacagaagagatcttagactagcatccaacgccatatgctcagcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgtggatcactcattggtctcacttccagagcaacctgggctcagaacatacttaccgcaatccaacaggtaagaagccttataggcaatgaagagtttctggactacatgccttcgatgaagagattcaggaaggaggaggagtcagagggagccatttggtaa

SEQ ID NO: 7753 - RNA, 9873 nt, synthetic construct
  misc_feature 1..9873: note = derived and/or modified CDS sequence (wt) from DENV-3__KC261634__SS-prME
  source 1..9873: mol_type = other RNA
acatcgatctgtcttatgatgatgttaccagcaacacttgctttccacctgacttcacgcgatggagagccgcgcatgattgtggggaagaatgaaagggggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacatgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggcttcaccatattagctctattccttgcccattacataggcacttccctgacccagaaagtggttatctttattctactaatgctggtcaccccatccatgacaatgagatgtgtgggagtaggaaacagagactttgtggaaggtttgtcaggagctacgtgggttgatgtggtgctcgagcacggtgggtgtgtgaccaccatggctaagaacaggcctacgctggacatagagcttcagaagaccgaggccacccaactggcgaccctaaggaagttatgcattgagggaaagattaccaacataacaaccgactcaaggtgtcccacccagggggaagcggttctacctgaggagcaggaccagaactacgtatgcaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatctaccgttgaagctgtcttgcctgagtatggaacccttgggctagaatgctcaccacggacaggcttggattttaatgaaatgattttgttgacaatgaagaacaaagcctggatggtacataggcaatggttctttgacctacccttaccatggacatcaggagccacaacagagacaccaacctggaacaggaaggaacttcttgtaacattcaaaaatgcacatgcaaaaaagcaagaagtagttgtccttggatcgcaagagggagcaatgcacacggcgctgacaggagctacagagattcaaaattcaggaggtacgagcatttttgcggggcacttgaaatgtagactcaagatggacaaattggaactcaaggggatgagctatgcaatgtgcttgaatacctttgtgttgaagaaagaagtctctgaaacgcagcatgggacaatactcattagggttgagtacaaaggggaagatgcaccttgcaagattcctttctccacagaggatggacaagggaaagcccacaatggtagactgatcacagccaacccagtggtgaccaagaaggaggagcctgtcaacatagaggctgaacctccttttggggaaagcaacatagtgattggaactggagataaagccttgaaaataaactggtacaagaagggaagctcgattgggaagatgttcgaggccactgccagaggtgcaaggcgcatggccatcttgggagacacagcctgggactttggttcagtgggtggtgttctaaattcattagggaaaatggcgcaccaaatattcggaagtgcttacacagccttgtttagcggagtctcatggataatgaaaattggaataggtgtcctcttaacctggatagggttgaattcaaaaaacacttccatgtcattttcatgtattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaagagactggcgacagccatcgcaggcgcttgggaaaatggagtctgtggaatcaggtcaacaaccagaatggagaatctattgtggaagcaaatagccaatgagctgaattacatattatgggaaaacaacatcaaattaacggtggtggtgggcgacataattggggtcttagaacaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagactacggttttggagtcttcacaaccaacatatggctgaaactccgagaagtgtacacccaatcatgtgaccataggctaatgtcggcagccatcaaagacgagagggccgtgcatgccgacatgggctattggatagaaagccaaaagaatggaagttggaagctagaaaaagcatccttcatagaggtaaaaacctgtacttggccaaaatcacacactctttggagcaatggtgtgctagagagtgacatgatcatcccaaagagtctagctggtcctatttcacaacacaaccacaggcccggataccacacccaaacggcaggaccttggcacttgggaaaattggagctggatttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgtaggggttctcttcacgtttgtgctccttctctcagggcaaataacatggagagatatgacacacacactcataatgattgggtccaacgcttccgacaggatgggaatgggcgtcacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcaaatggaattgctctggggctcatgactctaaaactgataacacaatttgagacatatcagttgtggacggcattagtctccttaacatgttcaaacacaattttcacattgactgttgcctggagaacagctaccctaattctggccggagtttcgcttttgccactgtgccagtcttcgagtatgaggaaaacagattggctcccaatgactgtggcagctatgggagtcccacccttaccactttttatcttcagcttgaaagacgcacccaaaaagaggagctggccactgaatgagggagtgatggctgttgggcttgtgagcattctagctagttctctccttaggaatgatgtgcccatggctggaccactagtggccgggggcttgttgatagcgtgttatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattgctaatagtatcaggcatctttccatactccatacccgccacactattggtttggcatacttggcaaaagcaaacccaaagatctggcgttctatgggacgtgcccagccccccagaaacacagaaagcagaactggaggagggggtctataggatcaaacaacagggaatttttgggaaaacccaagtgggagttggagtgcagaaagaaggagtcttccacaccatgtggcacgtcacaagaggggcagtgttgacgcacaatgggaaaagactggaaccaaactgggccagcgtgaaaaaagatctgatttcatatggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcagacaaatgcagaaccagacggaccgacaccggaattggaagaggaaatgtttaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcattgaaaggactcccaataaggtaccaaacaactgcaacaaaatctgaacacacaggaagggagattgttgatctaatgtgccacgcaacattcacaatgcgcttgttatcaccagtcagggttccaaattacaatttgataataatggatgaggcccatttcacagatccagccagcatagcggctagagggtacatatcaactcgtgtaggaatgggagaggcagctgcaattttcatgacagcaacaccccctggaactgctgaggcctttccccagagcaacgctccaattcaagatgaagaaagagatatcccggaacgttcatggaattcaggcaatgaatggattaccgactttgttgggaagacggtgtggttcgtccctagcatcaaagccggaaatgacatagcaaactgcctgcgaaaaaatggaaaaaaggttattcaacttagtaggaagacttttgatacagaataccaaaagaccagactgaatgattgggacttcgtggtgacgacagatatttcagaaatgggagctaattttaaagcggatagagtgattgacccaagaagatgtctcaagccagtaattttgacagatggacccgagcgagtgatcctggctggaccaatgccagtcaccgcagcgagcgccgcgcaaaggagagggagagttggcagaaacccacaaaaagaaaatgaccagtacatattcacgggccagcctctcaacaatgatgaagaccatgctcactggacagaagcaaaaatgctgctagacaacatcaacacaccagaagggatcataccagctctctttgaaccagagagggagaagtcagccgctatagacggtgaataccgcctgaagggtgagtctaggaagaccttcgtggaactcatgaggaggggtgacctcccagtttggctagcccacaaagtagcctcagaagggatcaaatacacagatagaaaatggtgctttgatggagaacgtaacaatcaaattttagaggagaacatggatgtggaaatctggacaaaggaaggagaaaggaaaaaattgagacccaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggtggtagggcctacaggcatgcagtggaggaactaccagaaacaatggaaacactcctactcctgggactcatgatcttattaacaggtggagcaatgcttttcttgatatcaggtaaaggaattggaaagacttcaataggactcatttgtgttattgtttccagcggcatgttatggatggctgatgttccacttcaatggatcgcgtcggctatagtcctggaattttttatgatggtgttgcttataccagaaccagaaaaacaaagaactccccaagacaaccaactcgcatatgtcgtgataggcatacttacactggctgcgatagtagcagctaatgaaatgggattgttggaaactacaaagagagatttaggaatgtctaaagaaccaggtgctgtttcttctaccagctatttagatgtagacttgcacccagcatcagcctggacattgtacgccgtggccacaacagtaataacaccaatgttgagacacaccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaatccactgactctcacagcggcagtacttctgctagttacacactatgccattataggtccaggattgcaggccaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttgatgagaacatcatgggcattgtgtgaagctctaaccctagccacaggaccaataacaacactctgggaaggatcacctggaaagttttggaataccacgatagctgtttccatggctaacatctttagagggagctacttagcaggagctgggcttgctttttctatcatgaaatcagttggaacaggaaggagaggaacggggtcacaaggcgaaaccttaggagaaaaatggaaaaagagattaaatcagctatcccggaaagagtttgacctttacaagaaatctggaatcactgaagtggatagaacagaagctaaagaagggttgaaaagaggagaaacaacacatcatgctgtgtccagaggcagcgcaaaacttcaatggttcgtggagaggaacatggtcattccagaaggaagagtcatagacttaggctgtggaagaggaggctggtcatattactgcgcaggactgaaaaaagtcacagaagtgcgaggatacacaaaaggcggcccaggacacgaagaaccagtacctatgtctacatatggatggaacatagtcaagttaatgagtggaaaggacgtgttttatcttccacctgaaaagtgtgacaccctattgtgtgacattggagaatcttcacctagtccaacagtggaagaaagcagaactataagagttttgaagatggttgagccatggctaaaaaacaaccagttttgcattaaagtattaaacccttacatgccaactgtgattgagcacctagaaagactgcaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatggagaaagatgtggatttgggagcaggaactcgacatgtcaatgcggaaccagaaacacccaacatggacgtcattggagaaagaataaaaaggatcaaggaagagcatagttcaacatggcactatgatgatgaaaatccttataaaacgtgggcttaccatggatcctatgaagtcaaagccacaggctcagcctcctccatgataaatggagtcgtgaaacttctcacaaaaccatgggatgtggttcccatggtgacacagatggcaatgacagacacaactccatttgggcagcaaagagttttcaaagagaaagtagacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcagctatgggagctgtttttacagaggagaaccaatgggatagtgcgagagctgctgttgaggacgaggaattctggaaacttgtggacagagaacgtgaactccacagattgggcaagtgtggaagctgtgtctacaacatgatgggcaagagagaaaagaaactcggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttgagagacatctctaagatacccggaggagccatgtatgctgatgacacagccggttgggacacaagaataacagaagatgacctgcacaacgaggaaaaaatcacacaacaaatggaccctgaacacagacgattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcaggcagatggaaggggaaggcgtgttgtcgaaggcagacctcgaggaccctcacctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatctaacgccatctgttcagcagtaccagtccattgggtccccacaagcagaacgacatggtccattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggattacatgccttcgatgaagagattcaggaaggaggaggagtcagaaggagccatctggtaa

SEQ ID NO: 7754 - RNA, 9873 nt, synthetic construct
  misc_feature 1..9873: note = derived and/or modified CDS sequence (wt) from DENV-3__JN662391__SS-prME
  source 1..9873: mol_type = other RNA
acatcgctctgtctcatgatgatattgccagcagcacttgctttccacttgacttcacgagatggagagccgcgcatgatcgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggccctcaggcacccagggttcaccatactagccctatttcttgcccattacataggcacctccttgacccagaaggtggttatttttatactactaatgctggtcaccccatccatgacaatgagatgtgtgggagtgggaaacagggattttgtggaaggtctgtcaggagctacatgggttgacgtggtgctagagcacggggggtgtgtgaccaccatggctaagaacaagcccacgctggatatagagcttcagaagaccgaggccacccaactggcgaccctaaggaagctatgcattgaggggaaaattaccaacataacaactgactcaagatgccccacccaaggggaagcggttttgcctgaggagcaggaccagaactacgtgtgtaagcatacatacgtagacagaggctgggggaacggttgtggtttgtttggcaagggaagcttggtaacatgtgcgaaatttcaatgcctggaaccgatagagggaaaagtggtgcaatatgagaacctcaagtataccgtcatcattacagtgcacacaggagaccaacaccaggtgggaaatgaaacgcagggagtcacggctgagataacgcctcaggcatcaaccactgaagccatcttgcctgaatatggaacccttgggctagagtgctcaccacggacaggtttggacttcaatgaaatgatcttactaacaatgaagaataaagcatggatggtacacagacaatggttttttgacctacctctaccatggacatcaggagctacaacagaaacaccaacttggaacaggaaggagctccttgtgacattcaaaaacgcacatgcgaaaaaacaagaagtagttgtccttggatcacaagagggagcaatgcataccgcactgacaggagccacagaaatccaaaactcaggaggcacaagcatttttgcggggcacttaaagtgtagacttaagatggacaaattggaactcaaggggatgagctatgcaatgtgcacgaatacctttgtgttgaagaaagaagtctcggaaacgcagcatgggacaatactcattaaggtcgagtacaaaggggaagatgcaccttgcaagattcctttctccacagaggatgaacaagggaaagctcacaatggcagactgatcacagccaacccagtggtgactaagaaggaggagcctgttaacattgaggctgaacctccttttggggaaagtaatatagtaattggaattggagacaatgccttgaaaatcaactggtacaagaagggaagctctattgggaagatgttcgaggctactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcctgggtgatgaaaattggaataggtgttctcttgacttggatagggttgaattcaaaaaacacatccatgtcattttcatgcattgcgataggaatcatcacactctatctgggagcagtggtacaagctgacatggggtgtgtcataaactggaaaggcaaagaacttaaatgcggaagtggaattttcgtcaccaacgaggtccatacctggacagagcagtacaaattccaagcggattccccaaaaagattggcgacagctattgcaggcgcttgggaaaatggagtgtgcggaattaggtcaacaaccagaatggagaatctcttgtggaagcagatagccaatgaactgaactacatattatgggaaaataatattaaattaacggtagttgtgggcgacacaattggggtcttggagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaactaacatatggctgaaactccgagaggtgtacacccaaatgtgtgaccacaggctaatgtcggcagccgtcaaggatgagagggccgtgcatgccgacatgggctattggatagaaagccaaaagaatggaagttggaagctagaaaaagcatccctcatagaggtgaaaacctgcacatggccaaaatcacacactctttggagcaacggtgtgctagagagtgacatgatcattccaaagagtctagctggtcctatttcgcaacacaactacaggcccgggtaccacacccaaacggcaggaccctggcacttaggaaaattggagctggacttcaactattgtgaaggaacaacagttgtcatcacagaaaactgtgggacgagaggcccatcattgagaacaacgacagtgtcaggaaagttgatacacgaatggtgttgccgctcgtgcacacttcctcctctgcgatacatgggagaagacggctgttggtatggtatggaaatcagacccatcagtgagaaagaagagaacatggtaaagtctttagtctcagcgggaagtggaaaggtagacaatttcacaatgggtgtcttgtgcttggcaatcctctttgaagaggtgatgagaggaaaatttgggaagaaacacatgattgcaggggttttcctcacgtttatgctccttctctcagggcaaataacatggagagacatggcgcacacactaataatgattgggtccaacgcctctgacaggatgggaatgggcgtcacctatctagctttaattgcaacatttaaaatccagccattcctggctttgggatttttcctaagaaaactgacatctagagagaatttactgttaggagttggattggctatggcaacaacgatacaactgccagaggacattgaacaaatggcaaatggaatcgccctagggctcatggctcttaaattgataacacaatttgaaacataccaattatggacagcattaatctccttaacgtgttcaaatacaattttcacgttgactgttgcctggagaacagccaccctgattttggccggagtttcacttttaccagtgtgccagtcttcgagcatgaggaaaacagactggcttccaatgacagtggcagctatgggagtcccacccctaccactctttatttttagcttgaaagacacactcaaaaggagaagctggccactgaatgaaggggtgatggctgttgggcttgtgagcattctggccagttctctccttagaaatgacgtgcccatggctggaccattagtggccgggggcttgttgatagcgtgctacgtcataactggcacgtcagcagaccttacagtagaaaaagcagcagatgtaacatgggaggaagaggctgagcaaacaggagtgtcccacaacttaatgatcacagttgatgatgatggaacaatgagaataaaagatgatgagactgagaatattctgacagtgcttttgaagacagcattactaatagtatcaggtatctttccatactccatacccgcaacattgttggtctggcatacttggcaaaagcaaacccaaagatccggtgttttatgggacgtacccagccccccagagacacagaaagcagaactggaagaaggggtctataggatcaaacagcaaggaattcttgggaaaacccaagtaggggttggagtacaaaaagaaggagtcttccacaccatgtggcacgtcacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacatttcagaccacaacaggggaaataggagcaattgcactggatttcaagcctggaacttcagggtctcctatcataaacagagagggaaaggtagtgggactatatggcaatggagtggttacaaagaatggcggctacgtcagcggaatagcgcaaacaaatgcagaaccagatggaccgacgccagagttggaagaagagatgttcaaaaagcgaaatctaaccataatggatcttcatcctgggtcaggaaagacacggaaataccttccagccattgttagagaggcaatcaagagacgtttaagaactctaattttggcaccgacaagggtggttgcagctgaaatggaagaagcattgaaagggctcccaataaggtaccaaacaacagcaacaaaatctgaacacacgggaagagagattgttgatctaatgtgccacgcaacgttcacgatgcgcttgctgtcaccagttagggttccaaattacaacttgataataatggatgaggcccatttcacagacccagccagtatagcggccagagggtacatatcaactcgtgttggaatgggagaggcagccgcaattttcatgacggcaacgccccctggaacagctgatgcctttcctcagagcaacgctccaattcaagatgaagaaagggacataccagaacgctcatggaattcaggcaatgaatggattaccgacttcgccgggaaaacggtgtggtttgtccccagcatcaaagccggaaatgacatagcaaactgcttgcgaaagaacgggaaaaaggtcattcaacttagtaggaagacttttgatacagaatatcagaagactaaactaaatgattgggactttgtggtgacaactgacatttcagaaatgggggccaatttcaaagcagatagagtgatcgacccaagaagatgtctaaaaccagtgatcctgacagatggaccagagcgggtgatcctggctggaccaatgccagtcaccgtggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacatcaacactccagaaggaatcataccagctctctttgaaccagaaagggagaagtcagccgccatagacggtgaatatcgcctgaagggtgaatccaggaagactttcgtggaactcatgaggaggggtgaccttccagtttggttagctcacaaagtagcatcagaagggatcaaatacacagatagaaaatggtgctttgatggacagcgtaacaatcaaattttagaggaaaacatggacgtggaaatctggacaaaggaaggagaaaagaaaaaattaagacctaggtggcttgatgcccgcacttattcagatcccttagcactcaaggaattcaaggactttgcggctggcagaaagtcaatcgcccttgatcttgtgacagaaataggaagagtgccttcacacctagcccacagaacgagaaacgctctggacaatctggtgatgctgcacacgtcagaacatggcggtagggcctacaggcatgcggtggaggaactaccagaaacaatggaaacactcctactcttgggactcatgatcttactgacaggtggagcaatgcttttcttgatatcaggtaaagggattggaaagacttcaataggactcatttgtgtgattgcttccagcggcatgctgtggatggccgaaatcccactccaatggatcgcgtcggctatagtcctggagttttttatgatggtgttgcttataccagaaccagaaaagcagagaaccccccaagacaaccaactcgcatatgtcgtaataggcatacttacattggctgcaataatagcggccaatgaaatgggactgttggaaactacaaagagagatttaggaatgtctaaggagccaggtgttgtttctccaactagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtaccactattggcattgggttgctattcacaagtgaacccattgactctaacagcggcagtacttttgctagttacacattatgctattataggtccaggactgcaggcaaaagccactcgtgaagctcaaaaaaggacagctgctggaataatgaagaatccaacggtggatgggataataacaatagacctagatcctgtaatatatgattcaaaatttgaaaagcaactgggacaggtcatgctcctggttttgtgtgcagttcaactgttgttaatgagaacatcatgggccttgtgtgaagccctaactttagctacaggaccaataacaacactctgggaaggatcacctgggaagttctggaataccacgatagctgtttccatggcgaacatttttagagggagctatttagcaggagctgggcttgccttttctattatgaaatcagttggaacaggaaaaagaggaacaggctctcaaggtgaaactttgggagaaaaatggaaaaagaaactgaatcaattatcccggaaagagtttgacctttacaagaagtctggaatcactgaagtggatagaacagaagccaaagaagggttgaaaagaggagaaacaacacatcatgccgtgtccagaggtagtgcaaaacttcaatggtttgtggagagaaacatggtcattcccgaaggaagagtcatagacctgggctgtggaagaggaggctggtcatattactgtgcaggactgaaaaaagtcacagaagtgcgaggatacacaaaaggcggtccaggacacgaagaaccagtgcctatgtcaacacatggatggaacatagttaagttaatgagtggaaaggatgtgttttatcttccacctgaaaagtgtgacaccctgttgtgtgacattggagaatcctcaccaagcccaacagtggaagaaagcagaactataagagttttgaagatggttgaaccatggctgaaaaacaaccagttttgcattaaagtattgaacccttacatgccagccgtgattgagcacctagagagactacaaaggaaacacggaggaatgcttgtgagaaatccactttcacgaaactccacgcacgaaatgtactggatatctaatggtacaggtaacattgtctcttcagtcaacatggtatccagactgttactgaacaggttcacgatgacacacaggagacctaccatagagaaagatgtggacttaggagcaggaactcgacatgttaatgcggaaccagaaacacccaacatggatgtcattggggaaagaataagaaggatcaaggaggagcataattcaacatggcactatgatgacgaaaacccctacaaaacgtgggcttaccacggatcttatgaagtcaaggccacaggctcagcctcctccatgataaatggagtcgtgaaacttctcactaaaccatgggatgtggtgcccatggtgacacagatggcaatgacagatacaactccatttggccagcagagagtttttaaagagaaagtggacaccaggacacccaggcctatgccagggacaagaaaggttatggagatcacagcggagtggctctggagaaccctgggaaggaacaaaagacccaggttatgcacaagggaagagtttacaaaaaaggtcagaaccaacgcagccatgggtgccgttttcacagaggagaaccaatgggacagtgcgaaagctgctgttgaggatgaagaattttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgaaaactcctacagtggagtagaaggagaaggactgcacaagctaggctacatattaagggacatttccaagatacccggaggagccatgtatgctgatgacacagctggttgggacacaagaataacagaagatgacctgcacaatgaggaaaagatcacacagcaaatgaaccctgaacacaggctgttagcgaacgctatatttaagctcacataccaaaacaaagtggtcaaagttcaacgaccgactccaacgggcacggtaatggacatcatatctaggaaagaccaaagaggcagtggacaggtgggaacttatggtctaaatacatttaccaacatggaagcccagttagtcagacaaatggaaggagaaggtgtgctgtcaaaggcagacctcgagaaccctcatctgccagaaaagaaaattacacaatggttggaaaccaaaggagtggagaggttaaaaagaatggccattagcggggatgattgcgtagtgaaaccaattgatgacaggttcgctaacgccctgcttgctctgaacgatatgggaaaggttcggaaagacatacctcaatggcagccatcaaagggatggcatgactggcagcaggttcccttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctatgcccaaatgtggagtctcatgtattttcacagaagagatctcagactagcgtccaatgccatatgttcagcagtaccagtccactgggtccccacaagtagaacgacatggtctattcatgctcaccatcagtggatgactacagaagacatgcttactgtttggaacagggtgtggatcgaggacaatccatggatggaagacaaaactccagttacaacctgggaaaatgttccatacctagggaagagagaagaccaatggtgcggatcacttattggtctcacttccagagcaacctgggcccagaacatatccacagcaattcaacaggtgagaagccttataggcaatgaagagtttctggactacatgccttcaatgaagagattcaggaaggaggaggagtcggagggagccatttggtaa

SEQ ID NO: 7755 - RNA, 9873 nt, synthetic construct
  misc_feature 1..9873: note = derived and/or modified CDS sequence (wt) from DENV-3__AY858043__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctccccatgttggcatgggactggacacacgcgcccaaacctggatgtcggctgaaggagcttggaggcaagccgagaaggtagagacatgggcccttaggcacccagggttcacaatactagccctatttcttgcccattatataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgactaccatggctaagaacaagcccacgctggacatagagctccagaagaccgaggccacccaactggcaaccctaaggaaactatgcattgagggaaaaatcaccaacgtgacaactgactcaaggtgccccacccaaggggaagcgattctacctgaggagcaggaccagaactacgtgtgtaggcacacatacgtggacagaggctggggaaacggttgtggtttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgttgaagccatcttacctgaatatggaacccttgggctagaatgctcaccacggacaggtttggatttcaatgagatgattttgttgacaatgaagaacaaagcatggatggttcatagacaatggttttttgacctacctctaccatggacatcaggggctacaacagaaacaccaacctggaataagaaagagcttcttgtgacattcaaaaatgcacacgcaaaaaaacaagaagtagtagtccttggatcgcaagaaggagcaatgcacacagcactgacaggagccacagagatccaaacctcaggaggcacaagtatttttgcggggcacttgaaatgcagactcaagatggataaattggaactcaaggggatgagctatgcaatgtgctcaaatgcctttgtgttgaagaaagaagtctctgaaacacaacatgggacaatactcattaaggtcgagtacaaaggggaagacgcaccttgcaaaattcctttctccacggaggatggacaagggaaagtccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgatcgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggcccttttcagtggagtctcctggataatgaaaattggaataggtgtccttttaacttggatagggttgaattcaaaaaacacttctatgtcattttcatgcattgtgataggaatcatcacactctatctgggagccgtggtgcaggctgacatggggtgtgtcataaactggaaaggcaaagaactcaaatgtggaagtggaattttcgttactaatgaggtccacacctggacagagcaatacaaatttcaagcagactcccccaaaagactggcgacagccattgcaggcgcctgggagaatggagtgtgcggaatcaggtcgacaactagaatggagaacctcttgtggaagcaaatagccaatgaactaaactacatactatgggaaaacaacatcaaattaacggtagttgtgggtgatataattggggtcttagagcaagggaaaagaacactaacaccacaacccatggagctaaaatattcatggaaaacatggggaaaggcgaaagtagtgacagctgaaatacaaaattcctcctttataatagatgggccaaacacaccagagtgtccaaatgcctcaagagcatggaatgtgtgggaggtggaagattacgggttcggagtcttcacaactaatatatggctgaaactccgagagatgtacacccaactatgtgaccacaggctaatgtcggcagccgttaaggatgagagagccgtacacgccgacatgggctattggatagaaagccaaaagaatggtagttggaagctagagaaggcatctctcatagaggtgaaaacctgtacatggccaaaatcacacactctctggagcaatggtgtgttggagagtgacatgattatcccaaagagtctggctggtcccatctcgcaacacaactacaggcccggataccacacccaaacggcaggaccctggcacctaggaaaattggagctggacttcaactattgtgaaggaacaacagttgtcatcacagaaaattgtgggacaagaggcccatcactgaggacaactacagtgtcagggaaattgatacacgaatggtgttgccgctcgtgcacacttcctcccctgcgatatatgggagaagacggctgctggtatggcatggaaattagacctattaatgagaaagaagagaacatggtaaagtctttagtctcagcagggagtggaaaggtggataacttcacaatgggtgtcttgtgtcttgcaatcctctttgaagaggtaatgagaggaaaattcgggaaaaagcacatgattgcaggggttctcttcatgtttgtgctccttctctcagggcaaataacatggagagacatggcgcgcacactcataatgattggatccaacgcctctgacagaatgggaatgggcgtcacttacctagcattgattgcaacattcaaaattcagccatttttggctttgggattcttcctgaggaaactgacatctagagaaaatttattattgggagttgggttggccatggcaacaacgttgcaactaccagaggacattgaacaaatggcgaatggaatagccttggggcttatggctcttaaattgataacacaatttgaaacataccaactatggacggcattagtctccctaacgtgttcaaacacaattttcacgttgactgtcgcctggagaacagccaccctgatcttggccggaatttcgcttttgccagtgtgccagtcttcgagcatgaggaaaacagattggctcccaatgactgtggcagctatgggagttccacctctaccactctttattttcagtttgaaagacacactcaaaaggagaagctggccactgaatgagggggtgatggccgttggacttgtgagcattctagcaagttctctccttaggaatgacgtacccatggctggaccattagtggctgggggcttgttgatagcgtgctacgtcataactggcacgtcagcagaccttactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagtcttccacactatgtggcacgtcacaagaggagcagtgttgacatacaatggaaaaagactggaaccaaactgggctagcgtgaaaaaagatctgatttcatacggaggcggatggagactgagtgcacaatggcgaaaaggagaagaggtgcaggttattgctgtagagcctgggaagaacccaaagaactttcaaactatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaatgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttagcaccaacaagggtggttgcagctgagatggaagaagcattgaaagggctcccaataaggtatcaaacaactgcaacaaaatctgaacacacagggaaagagattgttgatctaatgtgtcacgcaacgtttacaatgcgtttgctgtcaccagtcagagttccaaactacaacttgataataatggatgaggctcatttcacagacccagccagtatagcggctagagggtacatatcaactcgtgtaggaatgggagaagcagccgcaattttcatgacagccacacctcctggaacagctgatgcttttcctcagagcaacgctccaattcaagatgaagaaagagacataccagaacgctcatggaattcaggcaatgattggattactgactttgccggaaagactgtgtggtttgtccccagcatcaaagctggaaacgacatagcaaactgcttgcggaaaaatggaaaaaaggttattcaacttagtaggaaaacttttgacacagaatatcaaaagactaaactaaatgattgggactttgtggtgacaacagacatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggagaggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgctcgcacttactcagatcccttagcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagaacacggtgggagggcctacaggcatgcagtggaggaattaccagaaacaatggaaacattcttactcctgggactcatgatcctgttaacaggtggggcgatgctcttcttgatatcaggcaaaggggttggaaagacttcaataggactcatttgtgtagttgcttccagcggcatgttatggatggctgatatcccactccaatggatcgcgtcggccatagttctggagttttttatgatggtgctactaataccagaaccagaaaagcagagaactccccaagacaatcagcttgcatatgtcgtgataggcatacttacattggctgcgatagtagcagccaatgaaatgggattgttggaaaccacaaagagagatttggggatgtccaaagaaccaggtgttgtttcaccaaccagctatttggatgtggatttgcacccagcatcagcctggacattgtacgctgtggccacaacagtaataacaccaatgttgagacataccatagagaattctacagcaaatgtgtccctggcagctatagccaaccaggcagtggtcctgatgggtttagacaaaggatggccgatatcgaaaatggatttaggcgtgccactattggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcgttttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgagactttgggagaaaagtggaaaaagaaattgaatcaactatcccggaaagagtttgacctctacaagaaatccggaatcactgaagtggatagaacagaagccaaagaagggttgaaaagaggagaaacaacacaccatgccgtatccagaggcagcgcgaaacttcaatggttcgtggagagaaacatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactttattgtgtgacattggagaatcttcaccaagcccaacagtggaagagagcagaaccataagagtcttgaaaatggttgaaccatggctaaaaaataaccagttttgcattaaagtattgaacccttacatgccaactgtaattgagcacctagaaagactacaaaggaagcatgggggaatgcttgtgagaaatccactctcacgaaactccacgcacgaaatgtactggatatctaatggcacaggcaacatcgtctcttcagtcaacatggtatccagactgctactgaacagattcaccatgacatataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccctttggccagcaaagggtttttaaagagaaagtggacaccaggacacccaaacccatgccaggaacaagaaaggttatggagatcacagcggaatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaacagggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattatacaatggttggaaaccaaaggagtagagaggttgaaaagaatggccatcagcggggatgattgcgtggtgaaaccaatcgacgataggttcgccaatgccctgcttgccctgaatgacatgggaaaagttaggaaggacataccccaatggcagccatcgaggggatggcatgattggcaacaggtccctttctgctcccaccactttcatgaattgattatgaaagatggaagaaagttggtagtcccctgcagacctcaggatgaattaatagggagagcgagaatctctcagggagcaggatggagccttaaagaaactgcatgcttagggaaagcctacgcccagatgtgggctctcatgtattttcacagaagagatcttagactggcatccaacgccatatgttcagcagtgccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggctcagaacatacttaccgcaatccaacaggtaagaagccttataggcaatgaagagttcctggactacatgccttcgatgaagagattcaggaaggaggaggagtcagagggagccatttggtaa

SEQ ID NO: 7756 - RNA, 9873 nt, synthetic construct
  misc_feature 1..9873: note = derived and/or modified CDS sequence (wt) from DENV-3__AY858044__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacgatcacttacaaatgccccctcattactgaagtggagcctgaagacattgactgctggtgcaacctcacatcgacgtgggtgacctacggaacgtgcaaccaagctggagagcatagacgcgacaagagatcggtggcgttagctcctcatgttggcatgggactggacacacgcgcccaaacctggatgtcggctgaaggagcttggagacaagtcgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgactaccatggctaagaacaagcccacgctggacatagagctccagaagaccgaagccacccaactggcaaccctaaggaaactatgtattgaggggaaaatcaccaacgtgacaaccgactcaaggtgccccactcaaggggaagcgattctacctgaggagcaggaccagaactacgtgtgtaagcacacatacgtggacagaggctggggaaacggttgtggcttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtacatagacaatggtttttcgacctacctctaccatggacatcaggggctacaacagaaacaccaacctggaataagaaagagcttcttgtgacattcaaaaatgcacacgcaaaaaaacaagaggtagtagtccttggatcgcaagagggagcaatgcacacagcactgacaggagccacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggaccatactcattaaggtcgagtacaaaggggaagacgcaccttgcaagattcctttctccacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtccttttaacttggatagggttaaattcaaaaaacacttctatgtcattttcatgcattgtgataggaatcatcacactctatctgggagccgtggtgcaagctgatatggggtgtgtcataaactggaaaggcaaagaactcaaatgtggaagtggaattttcgtcactaatgaggtccacacctggacagagcaatacaaatttcaggcagactcccccaaaagactggcgacagccattgcaggcgcctgggagaatggagtgtgcggaatcaggtcgacaaccagaatggagaacctcttgtggaagcaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaaacttcgagagatgtacacccaactatgtgaccacaggcttatgtcggcagctgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttagagagtgacatgatcatcccaaagagtctggctggtcctatctcgcaacacaactacaggcccggataccacactcaaacggcaggaccctggcacctaggaaaattggagctggacttcaactattgtgaaggaacaacagttgtcatcacagaaaactgtgggacaagaggcccatcactgaggacaacaacagtgtcagggaagttgatacacgaatggtgttgccgctcgtgtacacttcctcccctgcgatatatgggagaagacggctgctggtatggcatggaaattagacccattaatgagaaagaagagaacatggtaaagtctttagtctcagcagggagtggaaaggtggataacttcacaatgggtgtcttgtgtcttgcaatcctctttgaagaggtaatgagaggaaaatttgggaaaaagcacatgattgcaggggttctcttcatgtttgtgctccttctctcagggcaaataacatggagagacatggcgcgcacactcataatgattggatccaacgcctctgacagaatgggaatgggcgtcacctacctagcattgattgcaacatttaaaattcagccatttttggctttgggattcttcctgaggaaactgacatctagagaaaatttattattgggagttgggttggccatggcaacaacgttgcaactgccagaggacattgaacaaatggcgaatggaatagccttggggctcatggctcttaaattgataacacaatttgaaacataccaactatggacggcattagtctccctaacgtgttcaaatacaattttcacgttgactgttgcctggagaacagccaccctgatcttggccggaatttcgcttttgccagtgtgccagtcctcgagcatgaggaaaacagattggctcccaatgactgtggcagctatgggagttccacctctaccactttttatcttcagtttgaaagacacacttaaaaggagaagctggccactgaatgagggggtgatggccgttggacttgtgagcatcctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtacttttgaaaacagcattactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagttttccatactatgtggcacgtcacaagaggggcagtgttgacatacaatggaaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagatggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggttgcagctgagatggaagaagcattgaaagggctcccaataaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaatcttcatgacagccacaccccctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagatatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttggcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagagcacggtgggagggcctacaggcatgcagtggaggaattaccagaaacaatggaaacactcttactcctgggactcatgatcctgttaacaggtggggcgatgctcttcttgatatcaggcaaaggggttggaaagacttcaataggactcatttgtgtagttgcttccagcggcatgttatggatggctgatatcccactccaatggatcgcgtcggccatagttctggagttttttatgatggtgctacttataccagagccagaaaagcagagaactccccaagacaatcaactcgcatatgtcgtgataggcatacttacattggctgcaatagtagcagccaatgaaatgggattgttggaaaccacaaagagagatttagggatgtccaaagaaccaggtgttgtctcgccaaccagctacttggatgtggatttgcacccagcatcagcctggacattgtacgctgtggccacaacagtaataacaccaatgttgagacataccatagagaattctacagcaaatgtgtccctggcagctatagccaaccaagcagtggtcctgatgggtttagacaaaggatggccgatatcgaaaatggacttaggcgtgcctctgttggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgcgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactctgggagaaaagtggaaaaagaaattgaaccaattatcccggaaagagtttgacctctacaagaaatccggaatcactgaagtggatagaacagaagccaaagaagggttgaaaagaggagaaacaacacaccatgccgtatccagaggcagcgcaaaacttcaatggttcgtggagagaaatatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaagagagcagaaccataagagtcttgaaaatggttgaaccatggctaaaaaataaccagttttgcattaaagtattgaacccttacatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggtttttaaagagaaagtggacaccaggacacccaaacccatgccaggaacaagaaaggttatggagatcacagcgggatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaacaaggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgacacagctgggtgggacacaagaataacagaagatgacctgcacaatgaggaaaaaatcacacagcaaatggaccctgaacacaggcagttggcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttaaaaagaatggctatcagcggggatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaaattggtagtcccctgcagaccccaggatgaattaatagggagagcgagaatctctcagggagcaggatggagccttaaagaaactgcatgcctagggaaagcctacgcccaaatgtgggctctcatgtattttcacagaagagatcttagactagcatccaacgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggctcagaacatacttaccgcaatccaacaggtaagaagccttataggcaatgaagagtttctggactacatgccttcgatgaagagattcaggaaggaggaggagtcagagggagccatttggtaa

SEQ ID NO: 7757 - RNA, 9873 nt, synthetic construct
  misc_feature 1..9873: note = derived and/or modified CDS sequence (wt) from DENV-3__AY858045__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacgatcacttacaaatgccccctcattactgaagtggagcctgaagacattgactgctggtgcaacctcacatcgacgtgggtgacctacggaacgtgcaaccaagctggagagcacagacgcgataagagatcggtggcgttagctcctcatgttggcatgggactggacacacgcgcccaaacctggatgtcggctgaaggagcttggagacaagtcgagaaggtagagacatgggcctttaggcacccagggttcacaatactagccctatttcttgcccattacataggcacttccttgacccagaaagtggtcattttcatactactaatgctggtcaccccatctatgacaatgagatgtgtgggagtaggaaacagagattttgtggaaggcctatcaggagctacgtgggttgacgtggtgctcgaacacggtgggtgtgtgactaccatggctaagaacaagcccacgctggacatagagctccagaagaccgaagccacccaactggcaaccctaagaaaactatgtattgaggggaaaatcaccaacgtgacaaccgactcaaggtgccccactcaaggggaagcgattctacctgaggagcaggaccagaactacgtgtgtaagcacacatacgtggacagaggctggggaaacggttgtggcttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggttagaatgctcaccacggacaggtttggatttcaatgaaatgattttgttgacaatgaagaacaaagcatggatggtacatagacaatggtttttcgacctacctctaccatggacatcaggggctacaacagaaacaccaacctggaataagaaagagcttcttgtgacattcaaaaacgcacacgcaaaaaaacaagaagtagtagtccttggatcgcaagagggagcaatgcacacagcactgacaggagccacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccatttttagtggagtctcctggataatgaaaattggaataggtgtccttttaacttggatagggttaaattcaaaaaacacttctatgtcattttcatgcattgtgataggaatcatcacactctatctgggagccgtggtgcaagctgatatggggtgtgtcataaactggaaaggcaaagaactcaaatgtggaagtggaattttcgtcactaatgaggtccacacctggacagagcaatacaaattccaggcagactcccccaaaagactggcgacagccattgcaggcgcctgggagaatggagtgtgcggaatcaggtcgacaaccagaatggagaacctcttgtggaagcaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaaacttcgagagatgtacacccaactatgtgaccacaggcttatgtcggcagctgttaaggatgagagagccgtacacgccgacatgggctattggatagaaagccaaaagaatggtagttggaagctagaaaaggcatctctcatagaggtaaaaacctgcacatggccaaaatcacacactctctggagcaatggtgtgttagagagtgacatgatcatcccaaagagtctggctggtcctatctcgcaacacaactacaggcccggataccacactcaaacggcaggaccttggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaattagacccattaatgagaaagaagagaacatggtaaagtctttagtctcagcagggagtggaaaggtggataacttcacaatgggtgtcttgtgtcttgcaatcctctttgaagaggtaatgagaggaaaatttgggaaaaagcacatgattgcaggggttctcttcatgtttgtgctccttctctcagggcaaataacatggagagacatggcgcgcacactcataatgattggatccaacgcctctgacagaatgggaatgggcgtcacttacctagcattgattgcaacatttgaaattcagccatttttggctttgggattcttcctgaggaaactgacatctagagaaaatttattattgggagttgggttggccatggcaacaacgttgcaactgccagaggacattgaacaaatggcgaatggaatagccttggggcttatggctcttaaattgataacacaatttgaaacataccaactatggacggcattagtctccctaacgtgttcaaatacaattttcacgttgactgttgcctggagaacagccaccctgatcttggccggaatttcgcttttgccagtgtgccagtcctcgagcatgaggaaaacagattggctcccaatgactgtggcagctatgggagttccacctctaccactttttatcttcagtttgaaagacacacttaaaaggagaagctggccactgaatgagggggtgatggccgttggacttgtgagcatcctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtacttttgaaaacagcattactaatagtgtcaggcatttttccatactccatacctgcaacacttttggtctggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagttttccacactatgtggcacgtcacaagaggggcagtgttgacatacaatggaaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagatggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggttgcagctgagatggaagaagcattgaaagggctcccaataaggtatcaaacaactgcaacaaaatctgaacacacagggaaagagattgttgatctaatgtgtcacgcaacgttcacaatgcgcttgctgtcaccagtcagagttccaaactacaacttgataataatggatgaggctcatttcacagacccagccagtatagcggctagagggtacatatcaactcgtgtaggaatgggagaggcagccgcaatcttcatgacagccacaccccctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagatatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatatatattcacgggccagcccctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttggcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagagcacggtgggagggcctacaggcatgcagtggaggaattaccagaaacaatggaaacactcttactcctgggactcatgatcctgttaacaggtggggcgatgctcttcttgatatcaggcaaaggggttggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttggggatgtccaaagaaccaggtgttgtctcgccaaccagctatttggatgtggatttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgcctctgttggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttttggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagagattgaatcaattatcccggaaagagtttgacctctacaagaaatccggaatcactgaagtggatagaacagaagccaaagaagggttgaaaagaggagaaataacacaccatgccgtatccagaggcagcgcaaaacttcaatggttcgtggagagaaatatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaagaaagcagaaccataagagtcttgaaaatggttgaaccatggctaaaaaataaccagttttgcattaaagtattgaacccttatatgccaactgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatacaggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggtttttaaagagaaagtggacaccaggacacccaaacccatgccaggaacaagaaaggttatggagatcacagcgggatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaacaaggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttgaaaagaatggccatcagcggggatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattaatagggagagcgagaatctctcagggagcaggatggagccttaaagaaactgcatgcctagggaaagcctacgcccaaatgtgggctctcatgtattttcacagaagagatcttagactagcatccaacgccatatgttcagcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggctcagaacatacttaccgcaatccaacaggtaagaagccttataggcaatgaagagtttctggactacatgccttcgatgaagagattcaggaaggaggaggagtcagagggagccatttggtaa

SEQ ID NO: 7758 - RNA, 9873 nt, synthetic construct
  misc_feature 1..9873: note = derived and/or modified CDS sequence (wt) from DENV-3__AY858046__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctactctttaagacagcctctggaatcaacatgtgcacactcatagccatggatttgggagaaatgtgtgatgacacgatcacttacaaatgccccctcattactgaagtggagcctgaagacattgactgctggtgcaacctcacatcgacgtgggtgacctacggaacgtgcaaccaagttggagagcatagacgcgataagagatcggtggcattagctcctcatgttggcatgggactggacacacgcgcccaaacctggatgtcggctgaaggagcttggagacaagtcgagaaggtagagacatgggcctttaggcacccagggtttacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgactaccatggctaagaacaagcccacgctggacatagagctccagaagaccgaagccacccaactggcaaccctaaggaaactatgcattgaggggaaaatcaccaacgtgacaactgactcaaggtgccccactcaaggggaagcgattctacctgaggagcaggaccagaactacgtgtgtaagcacacatacgtggacagaggctggggaaacggttgtggcttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaactgtcgaagccatcttacctgaatatggaacccttgggctagaatgctcaccacggacaggtttggatttcaatgaaatgattttgttgacaatgaagaacaaagcatggatggtacatagacaatggtttttcgacctacctctaccatggacatcaggggctacaacagaaacaccaacctggaataagaaagagcttcttgtgacattcaaaaacgcacacgcaaaaaaacaagaagtagtagtccttggatcgcaagagggagcaatgcacacagcactgacaggagccacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggattttggatcagtaggtggtgttttaaattcactagggaaaatggtgcaccaaatatttggaagtgcttacacagccctttttagtggagtctcctggataatgaaaattggaataggtgtccttttaacttggatagggttaaattcaaaaaacacttctatgtcattttcatgcattgtgataggaatcatcacactctatctgggagccgtggtgcaagctgatatggggtgtgtcataaactggaagggcaaagaactcaaatgtggaagtggaattttcgtcactaatgaggtccacacctggacagagcaatacaaatttcaggcagactcccccaaaagactggcgacagccattgcaggcgcctgggagaatggagtgtgcggaatcaggtcgacaaccagaatggagaacctcttgtggaagcaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaaacttcgagagatgtacacccaactatgtgaccacaggcttatgtcggcagctgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttagagagtgacatgatcatcccaaagagtctggctggtcctatctcgcaacacaactacaggcccggataccacactcaaacggcaggaccctggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaattagacccattaatgagaaagaagagaacatggtaaagtctttagtctcagcagggagtggaaaggtggataacttcacaatgggtgtcttgtgtcttgcaatcctctttgaagaggtaatgagaggaaaatttgggaaaaagcacatgattgcaggggttctcttcatgtttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatctagagaaaatttattattgggagttgggttggccatggcaacaacgttgcaactgccagaggacattgaacaaatggcgaatggaatagccttggggctcatggctcttaaattgataacacaatttgaaacataccaactatggacggcattagtctccctaacgtgttcaaatacaattttcacgttgactgttgcctggagaacagccaccctgatcttggccggaatttcgcttttgccagtgtgccagtcctcgagcatgaggaaaacagattggctcccaatgactgtggcagctatgggagttccacctctaccactttttatcttcagtttgaaagacacacttaaaaggagaagctggccactgaatgagggggtgatggccgttggacttgtgagcatcctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaacttaatgatcacagttgatgatgatggaacaatgagaataaaagatgatgagactgagaacatcttaacagtacttttgaaaacagcattactaatagtgtcaggcatttttccatactccatacctgcaacacttttggtttggcacacttggcaaaagcaaacccaaagatccggcgtcctgtgggacgtacccagccccccagagacacagaaagcagaactggaagaaggggtctataggatcaagcagcaaggaatttttggaaagacccaagtgggggttggagtacaaaaagaaggagttttccacactatgtggcacgtcacaagaggggcagtgttgacatataatggaaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagatggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggttgcagctgagatggaagaagcactgaaagggctcccaataaggtatcaaacaactgcaacaaaatctgaacacacagggaaagagattgttgatctaatgtgtcacgcaacgttcacaatgcgtttgctgtcaccagtcagagttccaaattacaacttgataataatggatgaggctcatttcacagacccagccagtatagcggctagagggtacatatcaactcgtgtaggaatgggagaggcagccgcaatcttcatgacagccacaccccctggaacagctgatgcctttcctcagagcaacgctccaattcaagatgaagaaagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagatatttcagaaatgggagccaatttcaaagcagacagagtgatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttggcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagagcacggtgggagggcctacaggcatgcagtggaggaattaccagaaacaatggaaacactcttactcctgggactcatgatcctgttaacaggtggggcgatgctcttcttgatatcaggcaaaggggttggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggaatgttggaaaccacaaagagagatttggggatgtccaaagaaccaggtgttgtctcgccaaccagctatttggatgtggatttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgcctctgttggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgtgaagctctaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaagaaatccggaattactgaagtggatagaacagaagccaaagaagggttgagaagaggagaaataacacaccatgccgtatccagaggcagcgcaaaacttcaatggttcgtggagagaaatatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtctacatatggatggaacatagtcaagctgatgagtggaaaggatgtgttttatcttccacctgaaaagtgtgacactctattgtgtgacattggagaatcttcaccaagcccaacagtggaagagagcagaaccataagagtcttgaaaatggttgaaccatggctaaaaaataaccagttttgcattaaagtattgaacccttatatgccaactgtgattgagcacctagaaagactacaaaggaaacatggaggaatgcttgtgagaaatccactctcacgaaactccacgcacgaaatgtactggatatctaatggcacaggcaacattgtctcttcagtcaacatggtatccagactgctactgaacagattcacaatgacatataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggtctttaaagagaaagtggacaccaggacacccaaacccatgccaggaacaagaaaggctatggagatcacagcgggatggctttggagaaccctgggaaggaacaaaagacccagattatgcacgagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaacaaggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagacatttccaagatacccggaggagctatgtatgctgatgacacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagtccagttgatcagacaaatggaaggagagggtgtgttgtcgaagacagacctcgagaaccctcatctgctagagaagaaaatcacacaatggttggaaaccaaaggagtggagaggttaaaaagaatggccatcagcggagatgattgcgtggtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaggatgaattaatagggagagcgagaatctctcagggagcaggatggagccttaaagaaactgcatgcctagggaaagcctacgcccaaatgtgggctctcatgtattttcacagaagagatcttagactagcatccaacgccatatgttcggcagtaccagtccattgggtccccacaagcagaacgacgtggtccatccatgctcaccatcagtggatgactacagaagacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggctcagaacatacttaccgcaatccaacaggtaagaagccttataggcaatgaagagtttctggactacatgccttcgatgaagagattcaggaaggaggaggagtcagagggagccatttggtaa

SEQ ID NO: 7759 - RNA, 9873 nt, synthetic construct
  misc_feature 1..9873: note = derived and/or modified CDS sequence (wt) from DENV-3__AY858047__SS-prME
  source 1..9873: mol_type = other RNA
acatcgctctgtctcatgatgatgttaccagcaacacttgctttccacttgacttcacgagatggagagccgcgcatgattgtggggaagaatgagagaggaaaatccctactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggtatgggactggacacacgcgcccagacctggatgtcggctgaaggagcttggagacaagttgagaaggtagagacatgggcctttaggcatccagggttcacaatactagccctatttcttgcccattacataggcacttccttgacccagaaagtggtcattttcatactactaatgctggtcaccccatccatgacaatgagatgtgtgggagtgggaaacagagattttgtggaaggcctatcaggagctacgtgggttgacgtggtgctcgaacacggtgggtgtgtgactaccatggctaagaacaagcccacgctggacatagagctccagaagaccgaggccacccaactggcaaccctaaggaaactatgtattgagggaaaaatcaccaacgtgacaaccgactcaaggtgccccacccaaggggaagcgattctacctgaggagcaggaccagaactacgtgtgtaagcacacatacgtggacagaggctggggaaacggttgtggtttgtttggcaagggaagcttggtaacatgcgcaaaatttcaatgtttggaattgatagagggaaaagtggtgcagcatgagaacctcaaatacaccgtcatcatcacagtgcatacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaacaaagcatggatggtacatagacaatggttttttgacctacctctaccatggacatcaggggctacaacagaaacaccaacctggaataagaaagagcttcttgtgacattcaaaaacgcacacgcaaaaaaacaagaggtagtagtccttggatcgcaagagggagcaatgcacacagcattgacaggagctacagagatccaaacctcaggaggcacaagtatttttgcggggcacttgaaatgcagactcaagatggacaaattggaactcaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtaaccaagaaggaggagcccgtcaatattgaggcagaacctccttttggggaaagtaatataataattggaataggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggcactttttagtggagtctcctggataatgaaaattggaataggtgtccttttaacttggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagtggaattttcgttactaatgaggtccacacctggacagagcaatacaaatttcaagcagactccccaaaaagattggcgacagccattgcaggcgcctgggagaatggagtgtgcggaatcaggtcgacaaccagaatggagaacctcttatggaagcaaatagccaatgaactaaactacatactatgggaaaacaacatcaaattaacggtagttgtgggtgatataattgggatcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaagctccgagaaatgtactcccaactatgtgaccataggctaatgtcggcagccgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaagagtctggctggtcctatctcgcaacacaattacaggcccggataccacacccaaacggcaggaccatggcacctaggaaaattggagctggacttcaactattgtgaaggaacaacagttgtcatcacagaaaattgtgggacaagaggtccatcactgaggacaacaacagtgtcagggaaattgatacacgaatggtgttgccgctcatgtacacttcctcccctgcgatatatgggagaagacggctgctggtatggcatggaaattagacccatcaatgagaaagaagagaacatggtaaagtctttagtctcagcagggagtggaaaggtggataacttcacaatgggtgtcttgtgtcttgcaatcctctttgaagaggtaatgagaggaaaattcgggaaaaagcacatgattgcaggggttctcttcacatttgtgctccttctctcagggcaaataacatggagagacatggcacgcacactcataatgattggatccaacgcctctgacagaatgggaatgggcgtcacttacctagcattgattgcaacatttaaaattcagccatttttggctttgggattcttcctgaggaaactgacatctagagaaaatttgttattgggagttgggttagccatggcaacaacgttgcaactgccagaggacattgaacaaatggcgaatggaatagccttggggctcatggctcttaaattgataacacaatttgaaacataccaactatggacggcattagtctccctaatgtgttcaaacacaatttttacgttgactgttgcctggagaacagccaccctgattttggccggaatttcgcttttgccattgtgccagtcttcgagcatgaggaaaacagattggcttccaatgactgtagcagctatgggagttccacctctaccactttttattttcagtctgaaagacacactcaaaaggagaagctggccactgaatgaaggggtgatggccgtaggacttgtgagcattctagcaagttctctccttaggaatgacgtacccatggctggaccattagtggctgggggcttgctgatagcgtgctatgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattgctaatagtgtcaggcatttttccatactccatacctgcaacacttttggtctggcacacttggcaaaagagaacccaaagatccggcgtcctgtgggacgtacccagtcccccagagacacaaaaagcagaactggaagaaggggtctataggatcaagcagcaaggaattcttggaaagacccaagtgggggttggagtacaaaaagaaggagttttccacactatgtggcacgtcacaagaggagcagtgttgacatacaatggaaaaagactggaaccaaactgggctagcgtgaaaaaagatctgatttcatacggaggaggatggagactgagtgcacaatggcaaaagggagaagaggtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggactctaattttggcaccaacaagggtggttgcagctgagatggaagaagcattgaaagggctcccaataaggtatcaaacaaccgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacagccacacctcctggaacagctgatgcctttccccagagcaacgctccaattcaagatgaagaaagagacataccagaacgctcatggaattcaggcaatgattggattaccgactttgccggaaagactgtgtggtttgtccccagcatcaaagctgggaatgacatagcaaactgcctgcggaaaaatggaaaaaaggtcattcaacttagtaggaaaacttttgacacagaatatcaaaagactaaactaaatgattgggactttgtggtgacaacagacatttcagagatgggagccaatttcaaagcagacagagtgatcgacccaagaagatgtctcaagccagtcattttgacagacggacccgagcgcgtgatcctggcgggaccaatgccagtcaccgtagcgagtgccgcgcaaaggagagggagagttggcaggaacccacaaaaagaaaatgaccaatacatattcacgggccagcctctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaacatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatttagctcacagaacgagaaacgctctggacaatctggtgatgttgcacacgtcagagcacggtgggagggcctacaggcatgcagtggaggaattaccagaaacaatggaaacactcttactcctgggactcatgattctgttaacaggtggggtgatgcttttcttgatatcaggcaaaggggtcggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggactgttggaaaccacaaagagagatttggggatgtccaaagaaccaggtgtcgcttcgccaaccagctatttggatgtggatttgcacccagcatcagcctggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggctgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatggaataatgacaatagacctagatcctgtaatatacgattcaaaatttgagaaacaattaggacaagttatgctcctggttctgtgtgcagttcaacttttgttaatgagaacatcatgggcattttgtgaagctctaaccctagccacaggaccaataacaacactctgggaaggatcacctgggaagttctggaacactacgatagctgtttccatggcgaacatctttagagggagctatttagcaggagctgggcttgctttttctatcatgaaatcagttggaacgggaaagagaggaacagggtcacaaggtgaaactttgggagaaaagtggaaaaagaaattgaatcaattatcccggaaagagtttgatctctacaagaaatccggaatcactgaagtggatagaacagaagccaaagaagggttgaaaagaggagagataacacaccatgccgtatccagaggcagcgcaaaacttcaatggttcgtggagagaaacatggtcattcctgaaggaagagtcatagacttgggctgtggaagaggaggctggtcatattattgtgcaggattgaaaaaagttacagaagtgcgaggatacacaaaaggcggcccaggacatgaagaaccagtacctatgtccacatatggatggaacatagtcaagctgatgagtggaaaggatgtgttttatctcccacctgaaaagtgtgacactctattgtgtgacattggagaatcttcaccaagcccaacagtggaggagagcagaaccataagagtcttgaaaatggttgaaccatggctaaaaaataaccagttttgcattaaagtattgaacccttacatgccagctgtgattgagcacctagaaagactacaaaggaaacatggaggaatgcttgtgagaaatccactctcacgaaactccacgcacgaaatgtactggatatctaatggcacaggcaacatcgtctcttcagtcaacatggtatccagactgctactgaacagattcacaatgacatataggagacctaccatagagaaagatgtggatttaggagcggggacccggcatgtcaatgcggaaccagaaacacccaacatggatgtcattggggaaagaataagaaggatcaaggaggagcatagttcaacatggcactatgatgatgagaatccttacaagacgtgggcttaccatggatcttatgaagttaaggccacaggctcagcctcctccatgataaatggagtcgtgaaactcctcacgaaaccatgggatgtggtgcccacggtgacacagatggcaatgacggacacgaccccttttggccagcaaagggtttttaaagaaaaagtggacaccaggacacccaaacccatgccaggaacaagaaaggtcatggagatcacagcggaatggctttggagaaccctgggaaggaacaaaagacccagattatgcacgagagaggagttcacaaaaaaggtcagaaccaacgcagctatgggcgccgtgttcacagaggagaaccaatgggacagtgctaaagctgccgttgaagatgaagaattctggaaactcgtggacagagaacgtgaactccacaaactgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagccatgtatgctgacgacacagctgggtgggacacaagaataacagaagatgacctgcacaatgaggaaaaaatcacacagcaaatggaccctgaacacaggcagttagcaaacgctatatttaagctcacatatcaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttaaaaagaatggccatcagcggggatgattgcgtagtgaaaccaatcgacgacaggttcgccaatgccctgcttgccctgaatgacatgggaaaagttaggaaggacataccccaatggcagccatcgaagggatggcatgattggcaacaggtccctttctgctcccaccactttcatgaattgattatgaaagatggaagaaagttggtagtcccctgcagacctcaagatgaattaatagggagagcgagaatctctcagggagcaggatggagccttaaagaaactgcatgcctagggaaagcctacgcccaaatgtgggctctcatgtattttcacagaagagatcttagactagcatccaatgccatatgttcagcagtaccagtccattgggtccccacaagcagaacgacgtggtccatccatgctcaccatcagtggatgactacagaagacatgcttatcgtttggaacagggtgtggatagaggacaatccatggatggaagacaaaactccagtcacaacttgggaagatgttccatatctagggaagagagaagaccaatggtgcggatcactcattggtctcacttccagagcaacctgggcccagaacatacttactgcaatccaacaggtaagaagccttataggcaatgaagagtttctggactacatgccttcgatgaagagattcaggaaggaggaggagtcagagggagccatttggtaa

SEQ ID NO: 7760 - RNA, 9873 nt, synthetic construct
  misc_feature 1..9873: note = derived and/or modified CDS sequence (wt) from DENV-3__HQ332170__SS-prME
  source 1..9873: mol_type = other RNA
acatcgctctgtctcatgatgatattgccagcagcacttgctttccacttgacttcacgagatggagagccgcgcatgattgtggggaaaaatgaaagaggaaaatccctactttttaagacagcctctggaatcaacatgtgcacactcatagccatggacttgggagagatgtgtgatgacacggtcacttacaaatgcccccatattaccgaagtggaacctgaagacattgactgctggtgtaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggccaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaatggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggaacttcttgtgacatttaaaaacgcacatgcgaaaaaacaagaagtagttgtccttggatcgcaagagggagcaatgcatactgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgactacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaattaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagcgcctcaagagcatggaatgtgtgggaggtggaagattacgggttcggagtcttcacaaccaacatatggctgaaactccgagaggtgtatacccaacaatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagtcgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagacatggcgcacacactaataatgattgggtccaacgcatctgacaggatgggaatgggcgttacctacctagctttaattgcaacattcaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccggaggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccataccagcaacattgttagtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacgtataatgggaaaagactggaaccaaactgggctagcgtgaaaaaagatctgatttcatacggaggaggatggagattgagcgcacaatggcaaaagggggaggaggtacaggttattgccgtagagcctgggaagaacccaaagaactttcaaactatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagccgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgattgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagctatgcttttcttaatatcaggcaaagggattggaaagacttcaataggactcatttgtgtaatcgcttccagtggcatgttgtggatggccgaaatcccactccaatggatcgcgtcggccatagtcctggagttttttatgatggtgctgctcataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggttctgatgggtttggacaaaggatggccaatatcaaaaatggacttaggagtacccctgctggcattaggttgctattcacaagtgaacccactgactctaacagcggcagtactcttgctgatcacacattatgctattataggtccaggactgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaagcatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccatcgagaaagatgtggatttaggagcaggaactcgacatgttaatgcggaaccagaaacacccaacatggatgtcattggggaaagaataaaaaggatcaaggaggagcataattcaacatggcattatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaagcccaggttgtgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaagcagttagcgaacgctatatttaaactcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7761 - RNA, 9873 nt, synthetic construct
  misc_feature 1..9873: note = derived and/or modified CDS sequence (wt) from DENV-3__AY858038__SS-prME
  source 1..9873: mol_type = other RNA
acatcgctctgtctcatgatgatgttaccagcaacacttgctttccatttgacttcacgagatggagagccgcgcatgattgtggggaagaatgaaagaggaaaatccctactttttaagacagcctctgggatcaacatgtgcacactcatagccatggatttgggagagatgtgtgatgatacggtcacttacaaatgccccctcattactgaagtggagcctgaagacattgactgctggtgcaacctcacatcgacgtgggtgacttacggaacgtgcaaccaagctggagagcatagacgcgataaaagatcggtggcgttagctccccatgtcggcatgggactggacacacgtactcaaacctggatgtcggccgaaggagcttggagacaagtcgagaaggtagagacatgggcctttaggcacccagggttcacaatactagccctatttcttgcccattacataggcacttccttgacccaaaaagtggtcattttcatactgctaatgctggtcactccatccatgacaatgagatgtgtgggagtaggaaacagagattttgtggaaggcctatcaggagctacgtgggttgacgtggtgctcgaacacggtgggtgtgtgactaccatggctaagaacaagcccacgctggatatagagctccagaagactgaggccacccaactggcgaccctaaggaaactatgcattgagggaaaaattaccaacgtaacaaccgactcaaggtgccccacccaaggggaagcgattttacctgaggagcaggaccagaactacgtgtgtaagcacacatacgtggacagaggctggggaaacggttgtggtttgtttggcaagggaagcttggtaacatgcgcgaaatttcaatgtttggaatcaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaaccctcgggctagaatgctcaccacggacaggtttggatttcaatgaaatgattttgttgacaatgaagaacaaagcatggatggtacatagacaatggttttttgacctacctctaccatggacatcaggggccacaacagaaacaccaacctggaataagaaagagcttcttgtgacattcaaaaacgcacacgcaaaaaaacaagaagtagtagtcctcggatcgcaagagggagcaatgcacacagcactgacaggagctacagagatccaaacctcaggaggcacaagtatttttgcggggcacttaaaatgcagactcaagatggacaaattggaactcaaggggatgagctatgcaatgtgcttaaatgcctttgtgttgaagaaagaagtctccgaaacacaacatgggacaatactcattaaggttgagtacaaaggggaagatgcaccttgcaagattcctttctccacggaggatggacaagggaaagcccacaatggcagactgatcacagctaacccagtggtgaccaagaaggaagagcctgtcaatattgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattagggaaaatggtgcaccaaatatttggaagtgcttacacggccctatttagtggagtctcctggataatgaaaattggaataggtgtccttttaacctggatagggttgaattcaaaaaacacttctatgtcattttcatgcattgcgataggaatcatcacactctatctgggagccgtggtgcaagctgacatggggtgtgtcataaactggaaaggcaaagaactcaaatgtggaagtggaattttcgtcactaatgaggtccacacctggacagagcaatacaaatttcaagcagactcccctaaaagactggcgacagccatcgcaggcgcttgggagaatggagtgtgcggaatcaggtcgacaaccagaatggagaacctcttgtggaagcaaatagccaatgaactgaactacatattatgggaaaacaacatcagattaacggtagttgtgggtgatacaattggggtcttacagcaagggaaaagaacactaccaccacaacccatggagctaaaatattcatggaaaacatggggaaaggcgaaaatagtgacagctaaaacacaaaattcctccttcataatagatgggccaaacacaccagagtggccaagtgcctcaagagcatggaatgtgtgggaggtggaagattatgggttcggagtcttcacaactaatatatggttgaaactccgagagatgtacacccaactatgtgaccacaggctaatgtcggcagccgttaaggatgagagagccgtacacgccgacatgggctattggatagaaagccaaaagaatggaagttggaagctagaaaaggcatcccttatagaggtgaaaacctgcacatggccaaaatcacacactctctggagcaatggtgtgctagagagcgacatgatcatcccaaagagtctggcaggtcctatttcgcaacacaactacaggcccggataccacacccaaacggcaggaccctggcacctaggaaaattggagctggacttcaattattgtgaaggaacaacagttgtcatcacagaaaattgtgggacaagaggcccatcactgaggacaacaacagtgtcagggaagttgatacacgaatggtgttgccgctcgtgtacacttcctcccctgcgatacatgggagaagacggctgctggtatggcatggaaattagacccattaatgagaaagaagagaacatggtaaagtctttagtctcagcagggagtggaaaggtggataacttcacaatgggtgtcttgtgtttggcaatcctctttgaagaggtgatgagaggaaaattcggaaaaaagcacatgattgcaggggtcctcttcacgtttgtgctccttctctcagggcaaataacatggagagacatggcgcgtacactcataatgattgggtccaacgcctctgacagaatgggaatgggcgtcacttacctagcattgattgcaacatttaaaattcagccatttttggctttgggattcttcctgaggaaactaacatctagagaaaatttattgttgggagttgggttggccatggcaacaacgttacaactgccagaggacattgaacaaatggcgaatggaatagctttggggctcatggctcttaaattggtaacacaatttgaaacataccaactatggacggcattagtctccctaatgtgttcaaacacaattttcacgttgactgttgcctggagaacagccaccctgattttggccggaatttcgcttttgccagtgtgccagtcttcgagcatgaggaaaacagattggctcccaatgactgtggcagctatgggagttccacccctaccactttttatcttcagtttgaaagacacgctcaaaaggagaagctggccactgaatgagggggtgatggccgttggacttgtgagcattctagcaagttctctccttaggaatgacgtacccatggctggaccattagtggctgggggcttgctgatagcgtgctacgtcataactggcacgtcagcagacctcactgtagaaaaagcagcagatgtgatatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacccgcaacactgttggtctggcacacttggcaaaagcaaacccaaagatccggcgtcctatgggacgtacccagccccccagagacacagaaagcagaactggaagaaggggtctataggatcaagcagcaaggaatttttgggaagacccaagtgggggttggagtacaaaaagaaggagttttccacaccatgtggcacgtcacaagaggagcagtgttgacacacaatgggaaaagactggaaccaaactgggctagcgtgaaaaaagatctgatctcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactgtatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctattattagagaggcaatcaagagacgcttaaggactctaattttggcaccaacaagggtggttgcagctgagatggaagaagcattgaaggggctcccaataaggtatcaaacaactgcaacaaaatctgaacacacagggaaagagattgttgatctaatgtgtcacgcaacgttcacaatgcgtttgctgtcaccagttagagttccaaactataacttgataataatggatgaggctcatttcacagacccagccagtatagcggctagagggtacatatcaactcgtgtaggaatgggagaggcagccgcaattttcatgacagccacaccccctggtacagctgatgcctttcctcagagcaacgctccaattcaagatgaagaaagagacataccagaacgctcatggaattcaggcaatgactggattaccgactttgccgggaagacggtgtggtttgtccctagcatcaaagctggaaatgacatagcaaactgcttgcggaaaaatggaaaaaaggtcattcaacttagtaggaagacttttgacacagaatatcaaaggactaaactaaatgattgggactttgtggtgacaacagacatttcagaaatgggagccaatttcaaagcagacagagtgatcgacccaagaagatgtctcaagccagtcattttgacagacggacccgagcgcgtgattctggcgggaccaatgccagtcaccgtagcgagtgctgcgcaaaggagagggagagttggcaggaacccacaaaaagaaaatgaccaatacatattcacgggccagcccctcaataatgatgaagaccacgctcactggacagaagcaaaaatgctgctagacaacatcaacacaccagaagggatcataccagctctctttgaaccagaaagggagaagtcagccgccatagacggcgaataccgcctgaaaggtgaatccaggaagaccttcgtggaactcatgaggaggggtgacctcccagtttggctagcccataaagtagcatcagaaggaatcaaatatacagacagaaaatggtgttttgatggagaacgcaacaatcaaattttagaggagaatatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacacttagcccacagaacgagaaacgctctggacaatctggtgatgttgcacacgtcagaacacggtgggagggcttacaggcatgcagtggaggaattaccagaaacaatggaaacactcttactcctgggactcatgatcctgttaacaggtggggcaatgcttttcttgatatcaggtaaggggattggaaagacctcaataggactcatttgcgtagttgcttccagcggtatgctatggatggctgatgtcccactccaatggatcgcgtcggccatagtcctggagttttttatgatggtgctacttataccagaaccagaaaagcagagaactccccaagacaatcaacttgcatatgtcgtgataggcatacttacattggctgcaatagtagcagccaatgaaatgggattgttggaaaccacaaagagagatttaggaatgtccaaagaaccaggtgttgtttctccaaccagctatttggatgtggatttgcacccagcatcagcctggacattgtacgctgtggccacaacggtaataacaccaatgttgagacataccatagagaattccacagcaaatgtgtccctggcagctatagccaaccaggcagtggtcctgatgggtttggacaaaggatggccgatatcgaaaatggacttaggcgtaccactattggcactgggttgctattcacaagtgaacccactaactctcacagcggcagtactcctgctagtcacgcattatgctattataggtccaggattgcaggcaaaagccactcgtgaagctcaaaaaaggacagctgctggaataatgaagaatccaacggtggatgggataatgacaatagacctagatcctgtaatatacgattcaaaatttgaaaagcaactaggacaggttatgctcctggttctgtgtgcagttcaacttttgttgatgagaacatcatgggcattttgcgaagctctaaccctagccacaggaccaataacaacactctgggaaggatcacctgggaagttctggaacaccacgatagctgtttccatggcgaacatctttagagggagctacttagcaggagctgggcttgctttttccatcatgaaatcagttggaacaggaaagagaggaacagggtcacaaggtgaaaccttgggggaaaagtggaaaaagaaattgaatcaattatcccggaaagagtttgacctttacaagaaatccggaatcactgaagtggatagaacagaagccaaagaagggttgaaaagaggagaaataacacaccatgccgtatccagaggcagcgcaaaacttcaatggttcgtggagagaaacatggtcatccctgaaggaagagtcatagacctgggctgtggaagaggaggctggtcatattattgtgcaggactgaaaaaagttacagaagtgcgaggatacacaaaaggtggcccaggacatgaagaaccagtacctatgtctacatacggatggaacatagtcaagctaatgagtggaaaggatgtgttttatcttccacctgaaaagtgtgacactctattgtgtgacattggagaatcttcaccaagcccaacagtggaagaaagcagaaccataagagtcttgaagatggttgaaccatggctaaaaaataaccagttttgcattaaagtgttgaacccttacatgccaactgtgattgagcacctagaaagactacaaaggaaacatggaggaatgcttgtgagaaatccactctcacgaaactccacgcacgaaatgtactggatatccaatggcacaggcaacatcgtctcttcagtcaacatggtatccagactgttactgaacagattcacaatgacacacaggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccacggtgacacagatggcaatgacggatacaacccctttcggccagcaaagggtttttaaagagaaagtggacaccaggacacctagacccatgccaggaacaagaaaggttatggagattacagcggaatggctttggagaaccctgggaaggaataaaagacccagattatgcacgagagaggagttcacaaaaaaggttagaaccaacgcagctatgggagccgtattcacagaggagaaccaatgggacagtgctagagctgccgttgaagatgaagaattctggaaacttgtggacagagaacgtgaactccacaaactgggcaagtgtggaagctgcgtttacaacatgatgggcaagagagagaagaaactcggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagacatttccaagatacccggaggagccatgtatgctgatgacacagctggttgggacacaagaataacagaagatgacctgcacaatgaggaaaaaatcacacagcagatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggcctgaacacattcaccaacatggaagcccagttaatcagacaaatggaaggagaaggtgtgttgtcgaaggcagacctcgagaaccctcatctgctagagaagaaaattacacaatggttggaaactaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcgaagggatggcatgattggcaacaggtccctttctgctcccaccactttcatgaattgatcatgaaagatggaagaaagttggtagtcccctgcagacctcaggatgaattaatagggagagcgagaatctctcaaggggcaggatggagccttaaagaaactgcatgcctagggaaagcctacgcccaaatgtgggctctcatgtattttcacagaagagatcttagactagcatccaatgccatatgttcagcagtaccagtccattgggtccccacaagcaggacgacgtggtccattcatgctcaccatcagtggatgactacagaggacatgcttactgtttggaacagggtgtggatagaggataatccatggatggaagacaaaactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccctcgatgaagagattcaggaaggaggaggagtcagagggagccatttggtaa

SEQ ID NO: 7762 - RNA, 9873 nt, synthetic construct
  misc_feature 1..9873: note = derived and/or modified CDS sequence (wt) from DENV-3__AY858039__SS-prME
  source 1..9873: mol_type = other RNA
acatcgctctgtctcatgatgatgttaccagcaacacttgctttccacttgacttcacgagatggagagccgcgcatgattgtggggaagaatgaaagaggaaaatccctactttttaagacagcctctggaatcaacatgtgcacactcatagccatggatttgggagaaatgtgtgatgacacggtcacttacaaatgccccctcattactgaagtggagcctgaagacattgactgctggtgcaacctcacatcgacgtgggtgacctacggaacgtgcaaccaagctggagagcatagacgcgataagagatcggtggcgttagctcctcatgtcggcatgggactggacacacgcgcccaaacctggatgtcggctgaaggagcttggagacaagtcgagaaggtagagacatgggcctttaggcacccagggttcacaatactagccctatttcttgcccattacataggcacttccttgacccagaaagtggtcattttcatactactaatgctggtcaccccatccatgacaatgagatgtgtgggagtaggaaacagagattttgtggaaggcctatcaggagctacgtgggttgacgtggtgctcgaacacggtgggtgtgtgactaccatggctaagaacaagcccacgctggacatagagctccagaagaccgaggccacccaactggcaaccctaaggaaactatgcattgagggaaaaatcaccaacgtgacaaccgactcaaggtgccccacccaaggggaagcgattctacctgaggagcaggaccagaactacgtgtgtaagcacacatacgtggacagaggctggggaaacggttgtggtttgtttggcaagggaagcttggtaacatgcgcgaaatttcaatgtttggaattaatagagggaaaagtggtgcagcatgagaacctcaaatacaccgtcatcatcacagtgcacacaggagaccaacaccaggtgggaaatgaaacgcagggagtcacggctgagataacaccccaggcatcaaccgtcgaagccatcttacctgaatatggaacccttgggctagaatgctcaccacggacaggtttggatttcaatgaaatgattttgttgacaatgaagaataaagcatggatggtacatagacaatggttttttgacttacctctaccatggacatcaggggctacaacagaaacaccaacctggaataagaaagagcttcttgtgacattcaaaaatgcacacgcaaaaaaacaagaagtagtagtccttggatcgcaagagggagcaatgcacacagcactgacaggagctacagagatccaaacctcaggaggcacaagtatttttgcggggcacttgaaatgcagactcaagatggacaaattggaacttaaggggatgagctatgcaatgtgctcaaatgcctttgtgttgaagaaagaagtctctgaaacacaacatgggacaatactcattaaggtcgagtacaaaggggaagacgcaccttgcaagattcctttctccacggaggatggacaagggaaagcccacaatggcagactgatcacagctaacccagtggtgaccaagaaggaggagcctgtcaatattgaggcagaacctccttttggggaaagtaacataataattggaattggagacaaagccttgaaaatcaattggtacaagaagggaagctcgattgggaagatgttcgaggccactgccagaggtgcaaggcgcatggccatcttgggagacacagcctgggactttggatcagtaggtggtgttttaaattcactagggaaaatggtgcaccaaatatttggaagtgcttacacggccctttttagtggagtctcctggataatgaaaattggaataggtgtcctcttaacttggatagggttgaattcaaaaaacacttctatgtcattttcatgcattgtgataggaatcatcacactctatctgggagccgtggtgcaagctgacatggggtgtgtcataaactggaaaggcaaagaactcaaatgtggaagtggaattttcgttactaatgaggtccacacctggacagagcaatacaaatttcaagcagactcccccaaaagactggcgacagccattgcaggcgcctgggagaatggagtgtgtggaatcaggtcgacaaccagaatggagaacctcttgtggaagcaaatagccaatgaactaaactacatattatgggaaaacaacatcaaattaacggtagttgtgggtgatataattggggtcttagagcaagggaaaagaacactaacaccacaacccatggagctaaaatattcatggaaaacatggggaaaggcgaaaatagtgacagctgaaatacaaaattcctcctttataatagatgggccaaacacaccagagtgtccaaatgcctcaagagcatggaatgtgtgggaggtggaagattacgggttcggagtcttcacaactaatatatggctgaaactccgagagatgtacacccaactatgtgaccacaggctaatgtcggcagccgttaaggatgagagagccgtacacgccgacatgggctattggatagaaagccaaaagaatggtagttggaagctagaaaaggcatctctcatagaggtgaaaacctgcacatggccaaaatcacacactctctggagcaatggtgtgttggagagtgacatgatcatcccaaagagtctggctggtcctatctcgcaacacaactacaggcccggataccacacccaaacggcaggaccctggcacctaggaaaattggagctggacttcaactattgtgaaggaacaacagttgtcatcacagaaaattgtgggacaagaggcccatcactgaggacaacaacagtgtcagggaaattgatacacgaatggtgttgccgctcgtgtacacttcctcccctgcgatatatgggagaagacggctgctggtatggcatggaaattagacccattaatgagaaagaagagaacatggtaaagtctttagtctcagcagggagtggaaaggtagataacttcacaatgggtgtcttgtgtcttgcaatcctctttgaagaggtaatgagaggaaaattcgggaaaaagcacatgattgcaggggttctcttcatatttgtgctccttctctcagggcaaataacatggagagacatggcgcgcacactcataatgattggatccaacgcctctgacagaatgggaatgggcgtcacttacctagcattgattgcaacatttaaaattcagccatttttggctttgggattcttcctgaggaaactgacatctagagaaaatttattattgggagttgggttggccatggcaacaacgttgcaactgccagaggacattgaacaaatggcgaatggaatagccctggggctcatggctcttaaattgataacacaatttgaaacataccaactatggacggcattagtctccctaacgtgttcaaacacaattttcacgttgactgttgcctggagaacagccaccctgattttggccggaatttcgcttttgccagtgtgccagtcttcgagcatgaggaaaacagattggctcccaatgactgtggcagctatgggagttccaccttcaccactttttattttcagtttgaaagacacactcaaaaggagaagctggccactgaatgagggggtgatggccgttggacttgtgagcattctagcaagttctctccttaggaatgacgtacccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcttaacagtgcttttgaaaacagcattactaatagtgtcaggcatttttccatactccatacctgcaacacttttggtctggcacacttggcaaaagcaaacccaaagatccggcgtcctgtgggacgtgcccagccccccagagacacagaaagcagaactggaagaaggggtctataggatcaagcagcgaggaatttttggaaagacccaagtgggggttggagtacaaaaagaaggagttttccacactatgtggcacgtcacaagaggagcagtgttgacatacaatggaaaaagactggaaccaaactgggctagcgtgaaaaaagatctgatttcatacggaggaggatggagactgagtgcacaatggcaaaaaggagaagaggtgcaggttattgccgtagagcctgggaagaacccaaagaactttcaaaccatgccaggcattttccagacaacaacaggggagataggagcgattgcactggacttcaagcctggaacttcaggatctcccatcataaacagagagggaaaggtagtgggactatatggcaatggagtggtcacaaagaatggtggctatgtcagtggaatagctcaaacaaacgcagaaccagacggaccgacaccagagttggaagaagagatgttcaaaaagcgaaatctaaccataatggatctccatcccgggtcaggaaagacgcggaaataccttccagctatagttagagaggcaatcaagagacgcttaaggactctaattctggcaccaacaagggtggttgcagctgagatggaagaagcattgaaagggctcccaataaggtatcaaacaactgcaacaaaatctgaacacacagggaaagagattgttgatctaatgtgtcacgcaacgttcacaatgcgtttgctgtcaccagtcagagttccaaactacaacttgataataatggatgaggctcatttcacagacccagccagtatagcggctagagggtacatatcaactcgtgtaggaatgggagaggcagccgcaattttcatgacagccacacctcctggaacagctgatgcctttcctcagagcaatgctccaattcaagatgaagaaagagacataccagaacgctcatggaattcaggcaatgattggattaccgactttgccggaaagactgtgtggtttgtccccagcatcaaagctggaaatgacatagcaaactgcttgcggaaaaatggaaaaaaggttattcaacttagtaggaaaacttttgacacagaatatcaaaagactaaactaaatgattgggactttgtggtgacaacagacatttcagaaatgggagccaatttcaaagcagacagagttatcgacccaagaagatgtctcaagccagtcattttgacagacggacccgagcgcgtgatcctggcgggaccaatgccagtcaccgtagcgagtgctgcgcaaaggagagggagagttggcaggaacccacaaaaagaaaatgaccaatacatattcacgggccagcccctcaacaatgatgaagaccacgctcactggacagaagcaaaaatgctgctagacaacatcaacacaccagaaggaatcataccagctctctttgaaccagaaagggagaagtcagccgccatagacggcgaataccgcctgaaaggtgagtccaggaagaccttcgtggaactcatgaggaggggtgacctcccagtttggctagcccataaagtagcatcagaaggaatcaaatacacagacagaaaatggtgttttgatggagagcgcaacaatcaaattttagaggagaatatggatgtggaaatctggacaaaggaaggagaaaagaaaaaattgaggcctaggtggcttgatgcccgcacttattcagatcccttagcgctcaaggaattcaaggactttgcggctggtagaaagtcgatcgcccttgatcttgtgacagaaataggaagagtgccttcacatttagcccacagaacgagaaacgctctggacaatctggtgatgttgcacacgtcagaacacggtgggagggcctacaggcatgcagtggaggaattaccagaaacaatggaaacactcttactcctgggactcatgatcctgttgacaggtggggcgatgcttttcttgatatcaggcaaaggggttggaaagacttcaataggactcatttgtgtagttgcttccagcggcatgttatggatggctgatatcccactccaatggatcgcgtcggccatagttctggagttttttatgatggtgctacttataccagaaccagaaaagcagagaactccccaagacaatcaactcgcatatgtcgtgataggcatacttacattggctgcaatagtagcagccaatgaaatgggattgttggaaaccacaaagagagatttagggatgtccaaagaaccaggtgttgtttcgccaaccagctatttggatgtggatttgcacccagcatcagcctggacattgtatgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtgccactattggcactgggttgctattcacaagtgaacccactaactctcacagcggcagtactcctgctagtcacgcattatgctattataggtccaggattgcaggcaaaagccactcgtgaagctcaaaaaaggacggctgctggaataatgaagaatccaacggtggatgggataatgacaatagacctagatcctgtaatatacgattcaaaatttgaaaaacaactaggacaagttatgctcctggttctgtgtgcagttcaacttttgttaatgagaacatcatgggcattttgtgaagctctaaccctagccacaggcccaataacaacactctgggaaggatcacctgggaagttctggaacaccacgatagctgtttccatggcgaacatctttagagggagttatttagcaggagctgggcttgctttttctatcatgaaatcagttggaacaggaaagagaggaacagggtcacaaggtgaaactttgggagaaaagtggaaaaagaaattgaatcaattatcccggaaagagtttgacctctacaagaaatccggaatcactgaagtggatagaacagaagccaaagaagggttgaaaagaggagaaataacacaccatgccgtatccagaggcagcgcaaaacttcaatggttcgtggagagaaacatggtcattcctgaagggagagtcatagacttgggctgtggaagaggaggctggtcatattattgtgcaggattgaaaaaagttacagaagtgcgagggtacacaaaaggcggcccaggacatgaagaaccagtacctatgtctacgtatggatggaacatagtcaagctgatgagtggaaaggatgtgttttatcttccacctgaaaagtgtgacactctattgtgtgacattggagaatcttcaccaagcccaacagtggaagagagcagaaccataagagtcttgaaaatggttgaaccatggctaaaaaataaccagttttgcatcaaagtattgaacccttacatgccaactgtgattgagcacctagaaagactacaaaggaaacatggaggaatgcttgtgagaaatccactttcacgaaactccacgcacgaaatgtactggatatctaatggcacaggcaacatcgtctcttcagtgaacatggtatccagactgctactgaacagattcacaatgacatataggagacccaccatagaaaaagatgtggatttaggagcggggacccgacatgtcaacgcggaaccagaaacacccaacatggatgtcattggggaaagaataagaaggatcaaggaggagcatagttcaacatggcactatgatgatgaaaatccttacaaaacgtgggcttaccatggatcttatgaagttaaggccacaggctcagcctcctccatgataaatggagtcgtgaaactcctcacgaaaccatgggatgtggtgcccacggtgacacagatggcaatgacggacacaaccccttttggccagcaaagggtttttaaagagaaagtggacaccaggacacccaaacccatgccaggaacaagaaaggtcatggagatcacagcggaatggctttggagaaccctgggaaggaacaaaagacccagattatgcacaagagaggagttcacaaaaaaggtcagaaccaacgcagctatgggcgccgtattcacagaggagaaccaatgggacagtgctagagctgccgttgaagatgaagaattctggaaactcgtggacagagaacgtgaactccacaaattgggcaagtgtggaagctgcgtttataacatgatgggcaagagagagaagaaacttggagagtttggcaaagcaaaaggcagtagagccatatggtacatgtggttgggagccaggtaccttgagttcgaggcactcggattcttaaatgaagaccattggttctcgcgtgaaaactcttacagtggagtagaaggggaaggactgcataagctgggatacatcttgagagatatttccaagatacccggaggagctatgtatgctgatgatacagctgggtgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggcagtggacaggtgggaacttatggtctgaatacattcaccaacatggaagcccagttgatcagacaaatggaaggagaaggtgtgttgtcgaagacagacctcgagaaccctcatctgctagagaagaaaattacacaatggttggaaaccaaaggagtggagaggttaaaaagaatggccatcagcggggatgattgcgtggtgaaaccaatcgacgacaggttcgccaatgccctgcttgccctgaatgacatgggaaaagttaggaaggacataccccaatggcagccatcgaagggatggcatgattggcaacaagtccctttctgctcccaccactttcatgaattaattatgaaagatggaagaaagttggtagtcccctgcagacctcaggatgaattaatagggagagcgagaatctctcagggagcaggatggagccttaaagaaactgcatgcctagggaaagcctacgcccaaatgtgggctctcatgtattttcacagaagagatcttagactagcatccaacgccatatgttcagcagtaccagtccattgggtccccacaagcagaacgacgtggtccatccatgctcaccaccagtggatgactacagaagacatgcttactgtttggaacagggtgtggatagaggacaatccatggatggaagacaaaactccagtcacaacttgggaagatgttccatatctagggaagagagaagaccaatggtgcggatcactcattggtctcacttccagagcaacctgggcccagaacatacttaccgcaatccaacaggtaagaagccttataggcaatgaagagtttctggactacatgccttcgatgaagagattcaggaaggaggaggagtcagagggagccatttggtaa

SEQ ID NO: 7763 - RNA, 9873 nt, synthetic construct
  misc_feature 1..9873: note = derived and/or modified CDS sequence (wt) from DENV-3__JN368477__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaacctcacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgaaaaccttaaatacactgtcatcatcacagtgcacacaggagaccaacaccaggtgggaaatgacacgcagggagtcacagttgagataacaccccaggcatcaaccgttgaagctgtcttgcctgagtatggaacccttggactagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgctcatgcaaaaaagcaagaagtggttgtccttggatcgcaagagggagcaatgcacacagcgctgacaggagctacagagattcaaaactcaggaggtacaagcatttttgcggggcatttgaaatgtagactcaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaaatggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacccatttagctttaattgcaacattcaaaattcagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactaataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatctttagcttgaaggacacacccaaaaggaggagctggccactgaatgagggagtgatggctgttgggcttgtgagcatcctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtttcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaggtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgacttcgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcttacaggcatgcagtagaggaactaccagaaacaatggaaacactcctactcttgggactcatgatcttattaacaggtggagcaatgcttttcttgatatcaggtaaagggattggaaagacttcaataggacttatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctattggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaggaagggttgaaaagaggagaaacaacacatcatgctgtgtccagaggcagcgcaaaacttcaatggttcgtggagaggaacatggtcattcccgaaggaagagtcatagacctaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccatggttaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctggacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggtgatgaagaatttctggactacatgccttcgatgaagagattcaggaaggaggaggagacagagggagccatttggtaa

SEQ ID NO: 7764 - RNA, 9873 nt, synthetic construct
  misc_feature 1..9873: note = derived and/or modified CDS sequence (wt) from DENV-3__EF643017__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaaccttacatcaacatgggtgacttacggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcagtatgagaacctcaaatacaccgtcatcatcacagtgcacacaggagatcaacaccaggtgggaaatgaaacgcagggagtcacggctgagataacaccccaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtggttgtccttggatcgcaagagggagcaatgcataccgcattgacaggagccacagaaatccaaaactcaggaggcacaagtattttttcagggcatttaaaatgtagacttaagatggacaaattggaactcaaggggatgagctatgcaatgtgcacgaatacctttgtgttgaagaaagaagtctcagaaacgcagcatgggacaatactcattaaggtcgagtacagaggggaagatgcaccttgcaagattcctttctccacagaggatggacaagggaaagctcacaatggcagactgattacagccaacccagtggtgactaagaaggaggagcctgtcaatatcgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccgaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgatatgatcaccccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccctgcgatacatgggagaagacggttgctggtatggcatggaaattagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtgttcttcacgtttgtgctccttctctcagggcaaataacatggagagacatgacgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattgatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagtttcacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacacgggaggaagaggctgagcaaacaggagtgtcccacaacttaatgaccacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacgccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggactaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgtcgtggatggccgaaatcccactccaatggatcgcgtcggctatagtcctggagttttttatgatggtgttgcttataccagaaccagaaaagcagagaaccccccaagacaaccaacttgcatatgtcgtgataggcatacttacattggctgcaataatagcagctaatgaaatgggattgttggaaactacaaagagagatttaggaatgtctaaggagccaggtgttgtctctccaaccagctatttagatgtggacttgcacccagcatcagcctggacattgtatgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtgcccctactggcattgggctgctattcacaagtgaacccactgactctaacagcggcagtactcttgctgatcacacattatgctatcataggtccaggattgcaggcaaaagccactcgtgaagctcagaaaaggacagctgctggaataatgaagaatccaacagtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagttatttagcaggagttgggcttgctttttctattatgaaatcagttggaacaggaaaaagaggaacaggctcacaaggtgaaactttaggagaaaaatggaaaaagaaattaaatcaattatcccggaaagagtttgatctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaaaaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtttttaaagagaaagtggacaccaggacacccaggtccatgccaggaacaagaagggtcatggggatcacagcggagtggctctggagaaccctgggaaggaacaaaaaacccaggttatgcacaagggaagagttcacaaaaaaggtcagaactaacgcagccatgggcgccgttttcacagaggagaaccaatgggacagcgcgaaagctgctgttgaggatgaagatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgactgcgtagtgaaaccaatcgatgacaggtttgctaatgccctgctcgctctgaacgatacgggaaaggttcggaaagacatacctcaatggcagccatcaaaaggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7765 - RNA, 9873 nt, synthetic construct
  misc_feature 1..9873: note = derived and/or modified CDS sequence (wt) from DENV-3__DQ675519__SS-prME
  source 1..9873: mol_type = other RNA
acatcgatctgtctcatgatgatgttaccagcaacacttgccttccacttgacttcacgagatggagagccgcgcatgattgtggggaagaatgaaagaggaaaatccctacttttcaagacagcctctggaattaacatgtgcacacttatagccatggatttgggagagatgtgtgatgacacggtcacttacaaatgccccctcattactgaagtggagcctgaagacattgactgctggtgcaaccttacatcgacatgggtgacctacggaacgtgtaatcaagctggagagcatagacgcgataagagatcggtggcgctagctccccatgtcggcatgggactggacacacgcacccaaacctggatgtcggctgaaggagcttggagacaagtcgagaaggtagagacatgggcctttaggcacccagggttcacaatattagccctatttcttgcccattacataggcacttccttgacccagaaagtggtcatcttcatattactaatgctggtcaccccatccatgacaatgaggtgtgtgggagtaggaaacagagattttgtggaaggcctatcaggagctacgtgggttgacgtggtgctcgagcacggagggtgtgtgaccaccatggctaagaacaagcccacgctggatatagagctccagaagaccgaggccacccaactggcgaccctaagaaaactatgcattgagggaaaaattaccaacgtaacaaccgactcaaggtgccccacccaaggggaagcgattttacctgaggagcaggaccaaaactacgtgtgtaagcacacatacgtggacagaggctggggaaacggttgtggtttgtttggcaagggaagcttggtaacatgcgcgaaatttcaatgtttggaatcaatagagggaaaagtggtgcagcatgagaacctcaaatacaccgttatcatcacagtgcacacaggagaccaacaccaggtgggaaatgaaacgcagggggtcacggctgagataacaccacaggcatcaaccgttgaagccatcttacctgaatatggaacccttgggttagaatgctcaccacggacaggtttagatttcaatgaaatgatcttgttgacaatgaagaacaaagcatggatggtacatagacaatggttttttgacctacctttaccatggacatcaggggctacaacagaaacaccaacctggaacaagaaagagcttcttgtgacattcaagaacgcacatgcaaaaaaacaagaagtagtggtccttggatcgcaagagggagcaatgcacacagcactgacaggagccacagagatccaaacctcaggaggcacaagcatctttgcggggcacttaaaatgcagactcaagatggacaaattggaactcaaggggatgagctatgcaatgtgcttgaatgcctttgtgttgaagaaagaagtctccgaaacgcaacatgggacaatactcattaaggttgagtacaaaggggaagatgcaccctgcaggattcctttctccacggaggatggacaagggaaagctcacaatggcagactaatcacagctaacccagtggtgaccaagaaggaggagcccgtcaatattgaggcagaacctccttttggggaaagcaacatagtgattggaattggagacaaagctttgaaaatcaactggtacaagaagggaagctcgattgggaagatgttcgaggccactgccagaggtgcaaggcgcatggccatcctgggagatacagcctgggactttggatcagtaggtggtgttttaaattcattaggaaaaatggtgcatcaaatatttggaagtgcttatacggccctatttagtggagtctcctggataatgaaaattggaataggtgtccttttaacctggatagggttgaactcaaaaaacacttctatgtcattttcatgcattgtgataggaatcatcacactctatctgggagccgtggtgcaagctgacatggggtgtgtcataaactggaaaggcaaagaactcaaatgtggaaatggaattttcgtcactaatgaggtccatacctggacagagcaatacaaatttcaagcagactcccccaaaagactggcgacagccattgcaggcgcttgggagaatggagtgtgcggaattaggtcaacaaccagaatggagaacctcttgtggaagcaaatagccaatgaactgaactacatattatgggaaaacaacatcaaattaacggtagttgtgggcgacataattggggtcttagagcaagggaaaagaacactaacaccacaacccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacacgccgacatgggctattggatagaaagccaaaagaatggaagttggaagctagaaaaagcatccctcatagaggtgaaaacctgcacatggccaaaatcacacactctttggagcaatggtgtgctagagagtgacatgattatcccaaagagtctagctggtcccatttcgcaacacaaccacaggcccgggtaccacacccaaacggcaggaccctggcacttaggaaagttggagctggacttcaactattgtgaaggaacaacagttgtcatcacagaaaattgtgggacaagaggcccgtcactgaggacaacaacagtgtcagggaagttgatacacgaatggtgttgccgctcgtgtacacttcctcccctgcgatacatgggagaggacggctgctggtatggcatggaaattagacccattaatgagaaagaagagaacatggtaaagtctttagtctcagcagggagtggaaaggtggataacttcacaatgggtgtcctgtgtttggcaatcctctttgaggaagtgatgagaggaaaatttgggaaaaaacacatgattgcaggggttctcttcacgtttgtgctccttctctcagggcaaataacatggagagacatggcgcacacactcataatgattgggtccaacgcctctgacagaatgggaatgggtgtcacttacctagcattgattgcaacatttaaaatccagccatttttggctttgggattctttctgaggaaactgacatctagagaaaatttattgttgggagttgggttggccatggcaacaacgttacaactgccagaggacattgaacaaatggcgaatggagtagctttggggcttatggctcttaaattaataacacaatttgaaacataccaactgtggacggcactagtctccctaatgtgttcaaacacaattttcacgttgactgttgcctggagaacagccaccctgattttggctggaatttcgcttttgccagtgtgccagtcttcgagcatgaggaaaacagattggctcccaatgactgtggcagctatgggagttccacctctaccactttttatcttcagtttgaaggacacgctcaaaaggagaagctggccactgaatgagggggtgatggccattggacttgtgagcattctggctagttctctccttaggaatgacgtgcccatggctggaccattagtggctgggggcttgctgatagcgtgctatgtcataactggcacgtcagcagacctcactgtagaaaaagcagcagatgtgacatgggaggaagaggctgagcaaacaggagtgtcccacaatttaatgatcacagttgatgatgatggaacaatgagaataaaagatgatgagactgagaacatcctaacagtgcttttgaaaacagcattactaatagtgtcaggcatttttccgtactccatacccgcaacactgctggtctggcacacctggcaaaagcaaacccaaagatccggcgtcctatgggacgtacccagccccccagagactcagaaggcagaactggaagaaggggtttataggattaagcagcaaggaatttttgggaaaacccaagtgggggttggaatacaaaaagaaggagttttccacaccatgtggcacgttacaagaggagcagtgttgacacacaatgggaaaagactggaaccaaactgggctagcgtgaaaaaagacctgatttcatacggaggaggatggagattaagtgcacaatggcaaaaaggagaggaggtgcaggttatcgccgtagagcctgggaagaacccaaagaactttcaaactatgccaggcattttccagacaacaacaggggagataggagcgattgcactggacttcaagcctggaacttcaggatcccccatcataaacagagagggaaaggtagtgggactgtatggcaatggagtggtcacaaagaatggtggctatgtcagtggaatagcacaaacaaatgcagaaccagacggaccgacaccagagttggaagaagaaatgttcaaaaagcgaaatctaactataatggatctccatcccgggtcaggaaagacacggaaataccttccaactattgtcagagaggcaatcaagagacgcttaaggactctaattttggcgccaacaagggtggttgcagctgagatggaagaagcattgaaagggctcccaataaggtatcaaacaactgcaacgaaatctgaacatacagggaaagagattgttgatctaatgtgccacgcaacgttcacaatgcgtttgctgtcgccagtcagagttccaaactacaacttgataataatggatgaggctcatttcacagacccagccagtatagcggctagagggtacatatcaactcgtgtaggaatgggagaggcagccgcaattttcatgacagccacaccccctggaacagctgatgcctttcctcagagcaacgctccaattcaagatgaagaaagggacataccagaacgctcatggaattcaggcaatgaatggattaccgactttgtcgggaagacggtgtggtttgtccctagcatcaaagctggaaatgacatagcaaactgcttacggaaaaacggaaaaaaggtcattcaacttagtaggaagacttttgacacagaatatcaaaagactaaactaaatgattgggactttgtggtgacaacagacatttcagaaatgggagccaatttcaaagcagacagagtgatcgacccaagaagatgcctcaagccagtgatcttgacagacggacccgagcgcgtgatcctagcgggaccaatgccagttaccgtagcgagcgctgcgcagaggagagggagggttggcaggaacccacaaaaggaaaatgaccaatacatattcacgggccagccccttaataatgatgaagaccacgctcactggacagaagcaaaaatgctgctagataacatcaacacaccagaagggatcataccagctctctttgaaccagaaagggagaagtcagccgccatagatggcgaataccgcctgaaaggtgagtccaggaagaccttcgtggaactcatgaggaggggtgacctcccagtctggctagcccataaagtagcatcagaagggatcaaatacacagatagaaaatggtgttttgatggagaacgcaacaatcaaattttagaggagaatatggatgtggaaatctggacaaaggaaggagaaaagaagaaattgaggcctaggtggcttgatgcccgcacttattcagatcccttggcgctcaaggaattcaaggactttgcggctggtagaaagtcaattgcccttgatcttgtgacagaaataggaagagtgccttcacacttagcctacagaacgagaagcgccctggacaatctggtgatgttgcacacgtcagaacatggcgggagggcctacaggcatgcagtggaggaactaccagaaacaatggaaacactcttactcctgggactcatgatcctgttaacaggcggggcaatgcttttcttgatatcaggtaaagggattggaaagacttcaataggactcatttgtgtagttgcttccagcggtatgttatggatggctgatgtcccactccaatggatcgcgtcggccatagtcctggagttttttatgatggtgctactcataccagaaccagaaaagcagagaactcctcaagacaatcaactcgcatatgtcgtgataggcatacttacattggctgcaatagtagcagccaatgaaatgggactgttggaaaccacaaagagagatttaggaatgtccaaagaaccaggtgtcgtttctccaaccagttacttggatgtggacttgcacccagcatcagcttggacattgtacgctgtggccacaacagtaataacaccaatgttgagacataccatagagaattccacagcaaatgtgtccctggcagctatagccaaccaggcagtggtcctgatgggtttagacaaaggatggccgatatcgaaaatggacttaggcgtaccactactggcactgggttgttattcacaagtgaacccactaactctcacagcggcagtacttctgctagtcacgcattatgccattataggtccaggattgcaggcaaaagccacccgtgaagctcaaaaaaggacagcagctggaataatgaagaatccaacggtggatgggataatgacaatagacctagatcctgtgatatacgattcaaaatttgaaaagcaactaggacaggttatgctcctggttctgtgtgcagttcaacttttgctaatgagaacatcatgggctttttgtgaagctctaaccctagccacaggaccgataacaacactctgggaaggatcacctgggaagttttggaataccacgatagctgtctccatggcgaacatctttagagggagctacttagcaggagctgggcttgctttttctatcatgaaatcagttggaacaggaaagagaggaacagggtcacaaggtgaaaccttgggagaaaagtggaaaaagaaattgaatcagttatcccggaaagagtttgatctttacaagaaatccggaatcactgaagtggatagaacaaaagccaaagaagggttgaaaagaggggaaacaacacaccacgccgtatccagaggcagcgcaaaacttcaatggttcgtggagagaaacatggtcatccccgaaggaagagtcatagacttgggctgtggaagaggaggctggtcatattattgtgcgggactgaaaaaagttacagaagtgcgaggatacacaaaaggcggcccaggacatgaagaaccagtacccatgtctacatacggatggaacatagtcaagttaatgagtggaaaggatgtgttttatcttccacctgaaaagtgtgataccctattgtgtgacattggagaatcttcaccaagcccaacagtggaagaaagcagaaccataagagtcctgaagatggttgaaccatggctaaaaaataaccagttttgcattaaagtattgaacccttacatgccaactgtgattgagcacctagaaagactacaaagaaaacatggaggaatgcttgtgagaaatccactctcacgaaactccacgcacgaaatgtactggatatctaatggcacaggcaatatcgtctcttcagtcaacatggtatccagattgctactgaacagattcacaatgacacataggagacccaccatagagaaagatgtggatttaggagcggggacccgacacgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaagccacaggctcagcctcctccatgataaatggagtcgtgaagctcctcacgaaaccatgggatgtggtgcccacggtgacacagatggcaatgacggatacaaccccattcggccagcaaagggtttttaaagagaaagtggacaccaggacacccagacctatgccaggaacaagaaaggttatggagatcacagcggaatggctttggagaaccctaggaaggaataaaagacccagactatgcacgagagaggagttcacaaaaaaggtcagaaccaacgcagctatgggcgccgttttcacagaggagaaccaatgggacagtgctagagctgccgttgaagatgaagaattctggaaactcgtggacagagaacgtgaactccacaagctgggcaagtgtggaagctgcgtttacaacatgatgggcaagagagagaagaaacttggagagtttggcaaagcaaaaggcagtagagctatatggtacatgtggttgggagccaggtaccttgagttcgaggcactcggattcttaaatgaagaccattggttctcgcgtgaaaattcttacagtggagtagaaggagaaggactgcataagctgggatacatcttaagagatatttccaagacacccggaggagctatgtatgctgatgacacagctggttgggacacaagaataacagaagatgacctgcacaatgaggaaaaaatcacacagcaaatggaccctgaacacaggcagttagcaaacgctatatttaagctcacataccaaaacaaagtggtcaaagttcaacgaccaactccaaagggcacggtaatggacatcatatctaggaaagaccaaagaggtagtggacaggtgggaacttatggcttgaatacatttaccaacatggaagcccagttaatcagacaaatggaaggagaaggtgtgttgtcgaaggcagacctcgagaaccctcatctgccagagaagaaaatcacacaatggttagaaaccaaaggagtagagaggttaaaaagaatggccatcagcggggatgattgtgtggtgaaaccaattgatgacaggttcgccaatgccctgcttgccctgaatgacatgggaaaagttaggaaggacatacctcaatggcagccatcgaagggatggcatgattggcaacaggtccctttctgctcccaccactttcatgaattgatcatgaaagatggaagaaagctggtagttccctgcagaccccaggatgaattaatagggagagcgagaatctctcaaggagcaggatggagccttaaagaaactgcatgcctagggaaagcctacgcccaaatgtggagtctcatgtattttcacagaagagatcttagactagcatctaacgccatatgttcagcagtaccagtccattgggtccccacaagcagaacgacgtggtctattcatgctcaccatcagtggatgactacagaagacatgcttactgtttggaacagggtgtggatagaggataatccatggatggaggataaaactccagtcacaacttgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcgatgaagagattcaggaaggaggaggagtcagagggagccatttggtaa

SEQ ID NO: 7766 - RNA, 9873 nt, synthetic construct
  misc_feature 1..9873: note = derived and/or modified CDS sequence (wt) from DENV-3__DQ675521__SS-prME
  source 1..9873: mol_type = other RNA
acatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctattccttgcccattacataggcacttccctgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtggttactaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttagagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtagttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7767 - RNA, 9873 nt, synthetic construct
  misc_feature 1..9873: note = derived and/or modified CDS sequence (wt) from DENV-3__DQ675522__SS-prME
  source 1..9873: mol_type = other RNA
acatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctattccttgcccattacataggcacttccctgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7768 - RNA, 9873 nt, synthetic construct
  misc_feature 1..9873: note = derived and/or modified CDS sequence (wt) from DENV-3__DQ675527__SS-prME
  source 1..9873: mol_type = other RNA
acatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctattccttgcccattacataggcacttccctgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcattaatcaaattttagaggagaacatggatgtggaaatctggacaaaggaaggagaaaggaaaaatttgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7769 - RNA, 9873 nt, synthetic construct
  misc_feature 1..9873: note = derived and/or modified CDS sequence (wt) from DENV-3__DQ675528__SS-prME
  source 1..9873: mol_type = other RNA
acatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctattccttgcccattacataggcacttccctgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtagttgtccttggatcgcaagagggagcaatgcacacagtgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccattctgggagacaccgcttgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcctatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggccatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7770 - RNA, 9873 nt, synthetic construct
  misc_feature 1..9873: note = derived and/or modified CDS sequence (wt) from DENV-3__DQ675530__SS-prME
  source 1..9873: mol_type = other RNA
acatcgttctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctattccttgcccattacataggcacttccccgacccagaaagtggttatttttattctactaatgctggtcactccatccatgacaatgagatgcgtgggagtaggaaacagagactttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaatcaccaacataacaactgactcaaggtgtcctacccaaggggaagcgattttacctgaggagcaggaccagaactacgtatgtaagcacacatacgtggatagaggttggggaaacggttgtggcttgtttggaaaaggaagcttggtgacatgcgcgaaatttcaatgtctagaaccaatagagggaaaagtggtgcaatatgagaacctcaaatacactgtcatcatcacagtgcacacaggagaccaacaccaggtgggaaatgacacgcagggagtcacggttgagataacgccccaggcatcaaccgttgaagctgtcctgcctgagtatggaacccttgggctagaatgctcaccacggacaggcttggatttcaatgaaatgattctattgacaatgaagaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaattcaggaggtacgagcatttttgcggggcatttgaaatgtagacttaagatggacaaattggaactcaaggggatgagctatgcaatgtgcttgaatacctttgtgttgaagaaggaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccttgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaatacaaaattcctctttcataatagatgggccaaacacaccggagtgtccaagtgcctcaagagcatggaatgtgtgggaggtggaagattacggttttggagtcttcacaaccaacatatggctgaaactccgagagatgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccggataccacacccaaacggcaggaccttggcacttgggaaaattggagctggacttcaactattgcgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacccatcaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgtaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcttaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggtatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccattgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctgatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagccttcccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcattcaacttagtaggaagacttttgacacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaattttttatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagtaggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacactctattgtgtgacattggagaatcttcaccaagtccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgttaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaacttctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgcggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgagcgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgatatgggaaaggttaggaaggacatacctcaatggcagccatcaaaggggtggcatgattggcaacaggtccctttctgctcccaccactttcatgaactgattatgaaagatggaagaaagttggtggttccctgcagaccccaggacgaactaataggaagggcaagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7771 - RNA, 9873 nt, synthetic construct
  misc_feature 1..9873: note = derived and/or modified CDS sequence (wt) from DENV-3__DQ675533__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggatttgggagagatgtgtgatgacacggtcacttacaaatgcccccacattaccgaagtggaacctgaagacattgactgctggtgcaaccttacatcaacatgggtgacttatggaacgtgcaatcaagctggagagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcacttccctgacccagaaggtggttattttcatattattaatgctggtcaccccatccatgacaatgagatgtgtgggagtaggaaacagagattttgtggaagggctatcaggagctacgtgggttgacgtggtgctcgagcacggggggtgtgtgactaccatggctaagaacaagcccacgctggatatagagcttcagaagaccgaggccacccaactggcgaccctaaggaagctatgcattgagggaaaaattaccaacataacaactgactcaagatgtcctacccaaggggaagcggttttgcctgaggagcaggaccagaactacgtgtgtaagcatacatacgtagacagaggctgggggaacggttgtggtttgtttggcaaaggaagcttggtgacatgcgcgaaatttcaatgcctggaaccaatagagggaaaagtggtgcaatatgagaacctcaaatacaccgtcatcattacagtgcacacaggagaccaacaccaggtgggaaatgaaacgcaaggagtcacggctgagataacacctcaggcatcaacccatgaagcactcttgcctgaatatggaacccttgggctagaatgctcaccacggacaggtttggatttcaatgaaatgatcttactaacaatgaagaacaaagcatggatggtacatagacaatggttctttgacctacctctaccatgggcatcaggagctacaacagaaacaccaacctggaacaggaaggagcttcttgtgacattcaaaaacgcacatgcgaaaaaacaagaagtagttgtccttggatcgcaagagggagcaatgcataccgcactgacaggagctacagaaatccaaaactcaggaggcacaagcattttcgcggggcacttaaaatgtagacttaagatggacaaattggaactcaaggggatgagctatgcaatgtgcacgaatacctttgtgttgaagaaagaagtctcagaaacgcagcacgggacaatactcattaaggttgagtacaaaggggaagatgcaccttgcaagattcccttttccacagaggatggacaagggaaagctcacaatggcagactgatcacagccaaccctgtggtgactaagaaggaggagcctgtcaatattgaggctgaacctccttttggggaaagcaatatagtaattggaattggagacaacgccttgaaaatcaactggtacaagaaggggagctcgattgggaagatgttcgaggccactgccaggggtgcaaggcgcatggccatcttgggagacacagcttgggactttggatcagtgggtggtgttctgaactcattaggcaaaatggtgcaccaaatatttggaagtgcttatacagccctgttcagtggagtctcttgggtgatgaaaattggaataggtgtcctcttgacttggatagggttgaattcaaaaaacacatccatgtcattttcatgcattgcgataggaatcattacactctatctgggagctgtggtacaagctgacatggggtgtgtcataaactggaagggcaaagaactcaaatgtggaagcggaattttcgtcaccaatgaggtccatacttggacagagcaatacaaattccaagcagactccccaaaaagattggcaacagccattgcaggcgcttgggagaatggagtgtgtggaattaggtcaacaaccagaatggagaatctcttgtggaagcaaatagccaatgaactgaactacatattatgggaaaacaatatcaaattaacggtagttgtgggcgatacacttggggtcttagagcaagggaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtaaaaacctgcacatggccaaaatcacacactctctggagtaatggtgtgctagagagtgacatgatcatcccaaagagtctagctggtcctatctcacaacacaactacaggcccgggtaccacacccaaacggcaggaccctggcacttaggaaaattggagctggacttcaactactgtgaaggaacaacagttgtcatcacagaaagctgtgggacaagaggcccatcattgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgttgagaggaaaatttgggaagaaacacatgattgcaggggttttctttacgtttgtgctccttctctcagggcaaataacatggagagacatggcgcacacactaataatgatcgggtccaacgcctctgacaggatgggaatgggcgtcacctacctagctctaattgcaacatttaaaatccagccattcttggctttgggatttttcctaagaaagctgacatctagagaaaatttattgttaggagttgggttggccatggcaacaacgttacaactgccagaggacattgaacaaatggcaaatggaatcgctctggggctcatggctcttaaactgataacacaatttgaaacataccaattgtggacggcattagtctccttaacgtgttcaaacacaatttttacgttgactgttgcctggagaacagccactctgattttggccggagtttcgcttttaccagtgtgccagtcttcaagcatgaggaaaacagattggctcccaatgacagtggcagctatgggagttccaccccttccacttcttatttttagcttgaaagacacactcaaaaggagaagctggccactgaatgaaggggtgatggctgttgggcttgtgagcattctggccagttctctccttagaaatgatgtgcccatggctggaccattagtggccgggggcttgctgatagcgtgctacgtcataactggcacgtcagcggacctcactgtagaaaaagcagcagatgtaacatgggaggaagaggctgagcagacaggagtgtcccacaacttaatgatcacagttgatgatgatggaacaatgagaataaaagatgatgagactgagaacatcctaacagtgcttttaaaaacagcattactaatagtatcaggcatttttccatactccatacccgcaacattgttggtctggcacacttggcaaaaacaaacccaaagatccggcgttttatgggacgtacccagccccccagagacacagaaagcagaactggaagaaggggtttataggatcaaacagcaaggaatttttgggaaaacccaagtaggggttggagtacagaaagaaggagtcttccacaccatgtggcacgtcacaagaggggcagtgttgacacataatgggaaaagactggaaccaaactgggctagtgtgaaaaaagatctgatttcatatggaggaggatggagactgagcgcacaatggcaaaagggggaggaggtgcaggttattgccgtagagccagggaagaacccaaagaactttcaaaccatgccaggcacttttcagactactacaggggaaataggagcaattgcattggatttcaagcctggaacttcaggatctcctatcataaatagagagggaaaggtagtgggactgtatggcaatggagtggttacaaagaatggtggctatgtcagcggaatagcgcaaacaaatgcagaaccagatggaccgacaccagagttggaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtttgctgtcaccagttagggttccaaattacaacttgataataatggatgaggcccatttcacagacccagccagtatagcggctagagggtacatatcaactcgtgttggaatgggagaggcagccgcaatcttcatgacagcaacaccccctggaacagctgatgcctttcctcagagcaacgctccaattcaagatgaagaaagggacataccagaacgctcatggaattcaggcaatgaatggattaccgacttcgctgggaaaacggtgtggtttgtccctagcattaaagccggaaatgacatagcaaactgcttgcgaaaaaacgggaaaaaagtcattcaacttagtaggaagacttttgacacagaatatcagaagactaaactgaatgattgggactttgtggtgacaactgacatttcagaaatgggggccaatttcaaagcagatagagtgatcgacccaagaagatgtctcaaaccagtgatcttgacagatggaccagagcgggtgatcctggccggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggattataccagctctctttgaaccagaaagggagaagtcagccgccatagacggtgagtatcgcctgaagggtgagtccaggaagactttcgtggaactcatgaggaggggtgacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccctagcactcaaggaattcaaggattttgcagctggcagaaagtcaatcgcccttgatcttgtgacagaaataggaagagtgccttcacacttagcccacagaacgagaaacgccctggacaatttggtgatgctgcatacgtcagaacatggcggtagggcttacaggcatgcggtggaggaactaccagaaacaatggaaacactcctactcttgggacttatgatcttgttgacaggtggagcaatgcttttcttgatatcaggtaaagggattggaaagacttcaataggactcatttgtgtaatcgcttccagcggcatgttgtggatggccgaagttccactccaatggatcgcgtcggctatagtcctggagttttttatgatggtgttgctcataccagaaccagaaaagcagagaaccccccaagacaaccaacttgcatatgtcgtgataggcatacttacattggctgcaataatagcagccaatgaaatgggactgctggaaaccacaaagagagacttaggaatgtctaaggagccaggtgttgtttctccaaccagctatttggatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggcgtgccactactggcactgggttgctattcacaagtgaacccactgactctaactgcggcagtacttttgctaatcacacattatgctatcataggtccaggattgcaagcaaaagccacccgtgaagctcagaaaaggacagctgctggaataatgaagaatccaacagtggatgggataatgacaatagacctagatcctgtaatatatgattcaaaatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagagacaacacatcatgccgtgtcccgaggtagcgcaaaacttcaatggtttgtggaaagaaacatggtcgttcccgaaggaagagtcatagacttgggctgtggaagaggaggctggtcatattactgtgcaggactgaaaaaagtcacagaagtgcgaggatacacaaaaggcggtccaggacacgaagaaccagtacctatgtctacatatggatggaacatagttaagttaatgagcggaaaggatgtgttctatctcccacctgaaaagtgtgataccctgttgtgtgacattggagaatcttcaccaagcccaacagtggaagagagcagaactataagagttttgaagatggttgaaccatggctaaaaaacaaccagttttgcattaaagttttgaacccttacatgccaactgtgattgagcacctagaaagactacaaaggaaacatggaggaatgcttgtgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacgcccaggcccatgccagggacaagaaaggttatggagatcacagcggagtggctctggagaaccctgggaaggaacaaaagacccagattatgcacaagggaagagtttactaaaaaggtcagaactaacgcagccatgggcgccgttttcacagaggagaaccaatgggacagtgcgaaagctgctgttgaggatgaagaattttggaaacttgtggacagagaacgtgaactccacaaattgggcaaatgtggaagctgcgtttataacatgatgggcaagagagagaaaaaacttggagagtttggcaaagcaaaaggcagtagagctatatggtacatgtggttgggagccaggtaccttgagttcgaagcccttggattcttaaatgaagaccactggttctcgcgtgaaaactcttacagtggagtagaaggagaaggactgcacaagctaggctacatattaagggacatttccaagatacccggaggagccatgtatgctgatgacacagctggttgggacacaagaataacagaagatgacctgcacaatgaggaaaagatcatacagcaaatggaccctgaacacaggcagttagcgaacgctatattcaagctcacataccaaaacaaagtggtcaaagttcaacgaccgactccaacgggcacggtaatggatattatatctaggaaagaccaaaggggcagtggacaagtgggaacttatggcctgaatacattcaccaacatggaagcccagttagtcagacaaatggaaggagaaggtgtgctgacaaaggcagacctcgagaaccctcatctgctagagaagaaaatcacacaatggctggaaaccaaaggagtggagaggttaaaaagaatggccattagcggggatgattgcgtggtgaaaccaatcgatgacaggttcgctaatgccctgcttgctttgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaactgcatgtctggggaaagcctacgcccaaatgtggagtctcatgtattttcacagaagagatctcagattagcatccaacgccatatgttcagcagtaccagtccactgggttcccacaagtagaacgacatggtctattcatgctcaccatcagtggatgactacagaagacatgcttactgtttggaacagggtgtggatagaggaaaatccatggatggaagacaaaactccagttacaacttgggaaaatgttccatatctagggaagagagaagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagtcggagggagccatttggtaa

SEQ ID NO: 7772 - RNA, 9873 nt, synthetic construct
  misc_feature 1..9873: note = derived and/or modified CDS sequence (wt) from DENV-3__AY744677__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaaaaattaccaacgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcttatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttctgaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagactttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagagattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagatatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgcccaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7773 - RNA, 9873 nt, synthetic construct
  misc_feature 1..9873: note = derived and/or modified CDS sequence (wt) from DENV-3__AY744678__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaaaaattaccaatgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcactgctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacctctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatctaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggtcattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagacatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagagaagaaagttacacaatggttggaaacaaaaggagtggagaggttaaaaagaatggccatcagcggggatgattgcgtggtgaaaccaatcgatgacaggttcgccagtgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7774 - RNA, 9873 nt, synthetic construct
  misc_feature 1..9873: note = derived and/or modified CDS sequence (wt) from DENV-3__AY744679__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaagctatgtattgagggaaaaattaccaacgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagtggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcccttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgatagggatcattacactctatctgggagccgtggtgcaagctgacatggggtgtgtcataaactggaaaggccaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacggtagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgtcaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaaacacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacattcaaaattcagccatttttggctttgggattcttcctgaggaaactgacatccagagaaaatttattgctgggagttgggttggccatggcaacaacgttacaactgccagaggacattgaacaaatggcgaatggaatagctttagggctcatggctcttaaattaataacacaatttgaaacataccaactatggacggcattggtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacctctaccacttttcattttcagtttaaaagatacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgctagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaactctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatatcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattgtgtacgagagaggagttcatgaaaaaagtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtatatgtggttgggagccaggtaccttgagttcgaagcactcggattcttaaatgaagaccattggttctcgcgtgaaaactcttacagtggagtagaaggagaaggactgcataaactgggatacatcttaagagatatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaagcagacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagcgagaatctctcaaggagcaggatggagcctcagagaaactgcatgcctagggaaagcctacgcccaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtctcaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7775 - RNA, 9873 nt, synthetic construct
  misc_feature 1..9873: note = derived and/or modified CDS sequence (wt) from DENV-3__AY744680__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccttaaggaaactatgtattgagggaaaaattaccaacgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagattcaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggattttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgccgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagatatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaattgggagagctagaatctctcaaggagcaggatggagcctcagagaaactgcatgcctagggaaagcctacgcccaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7776 - RNA, 9873 nt, synthetic construct
  misc_feature 1..9873: note = derived and/or modified CDS sequence (wt) from DENV-3__AY744681__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcatcactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaagaattaccaacgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaagtgaaacgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacacagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaatttttgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacatgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacggcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttactgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcattaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaagaaacaaaagacccagattatgtacgagagaggagttcataaaaaaggtcagaaccaacgcagctatgggcgccgttttcacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagatatttccaagatacccggaggagctatgtatgctgatgacacagctggttgggacacaagaataacagaagatgacctgcacaatgaggaaaaaatcacacagcaaatggaccctgaacacaggcggttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgcccaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7777 - RNA, 9873 nt, synthetic construct
  misc_feature 1..9873: note = derived and/or modified CDS sequence (wt) from DENV-3__AY744682__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagatttcgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaaaaattaccaatgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcaccatcacagtgcacacaggagatcaacaccaggtgggaaatgaaacgcagggagtcacagctgagataacaccccaggcatcaaccgttgaagccattttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagataaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcgaaaaacacttctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagaggtgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggacaacttcacaatgggtgtcttgtgtttggcaatcctctttgaagaggtgatgagaggaaaatttgggaaaaagcacatgatttcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccactagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtattgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaacagcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtcgcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgagaaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagccgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcacagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggacgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagacatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaacccttacctgctagagaagaaagttacacaatggttggaaacaaaaggagtggagaggttaaaaagaatggccatcagcggggatgactgcgtggtgaaaccaatcgatgacaggtttgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgtggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7778 - RNA, 9873 nt, synthetic construct
  misc_feature 1..9873: note = derived and/or modified CDS sequence (wt) from DENV-3__AY744683__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagccccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaaaaattaccaatgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacagctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgttcgaggctactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgcattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcaacagccattgcaggtgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataactttacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaatccagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaaacctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtctggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggcagatgtcccactccaatggatcgcgtcggccatagtcctggagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgtcgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggttccttgagttcgaagcactcggattcttaaatgaagaccattggttctcgcgtgaaaactcttacagtggagtagaaggagaaggactgcataaactgggatacatcttaagagacatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagaaaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatactcacggcaatccaacaggtgagaagccttataggcaatgaagagtttctggactacatgccttcaatgaagagattcaggaaggaggaggagtcagagggagccatttggtaa

SEQ ID NO: 7779 - RNA, 9873 nt, synthetic construct
  misc_feature 1..9873: note = derived and/or modified CDS sequence (wt) from DENV-3__AY744684__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcattactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccttgacccagaaagtggttattttcatactactaatgctggtcaccccatccatgacaatgagatgtgtgggagtaggaaacagagattttgtggaaggcctatcaggagctacgtgggttgacgtggtgctcgagcacggtgggtgtgtgactactatggctaagaacaagcccacgttggatatagagctccagaagaccgaggccacccaactggcgaccctaaggaaactatgtattgagggaaaaattaccaatgtaacaaccgactcaaggtgccccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaacgcagggagtcacagctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaatggcagactgatcacagctaacccaatagtgaccaagaaggaggagcctgtcaacatcgaggcagaacctccttttggggaaagtaatatagtaattggaattggagacaaagccttgaaaatcaactggtacaagaagggaagctcgattgggaagatgtttgaggctactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacacttctatgtcattttcatgtattgtgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcaacagccattgcaggtgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgcctcaagagcatggaatgtgtgggaggtggaagattacgggttcggagttttcacaactaacatatggctgaaactccgagagatgtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgtgaaggaacaacagttgtcatcacagaaaattgtgggacaagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaaggcggataacttcacaatgggtgtcttgtgtttggcaatcctctttgaagaggtgatgagaggaaaatttgggaaaaagcacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttgggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattagtctccctaatgtgttcaaatacaatttccacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactgaatgagggggtgatggctgttggacttgtgagcattctagctagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggggttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcattttccagacaacaacaggggagataggagcgattgcactggacttcaaacctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcaaacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagacataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgatcgacccaagaagatgtctcaagccagtgattttgacagacggacccgagcgcgtgatcctggcgggaccaatgccagtcaccgtagcgagcgctgcacaaaggagagggagagttggcaggaacccacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataaccaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggcagatgtcccactccaatggatcgcgtcggccatagtcctagagtttttcatgatggtgttacttataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaacccactaactctcacagcggcagtactcctgctagtcacgcattatgctatcataggtccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgtgcagttcaacttttgttaatgagaacatcatgggctttttgtgaagctctaaccctagccacaggaccaataacaacactctgggaaggatcacctgggaagttctggaacaccacgatagctgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatacggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacctagaaagactacaaaggaaacatggaggaatgcttgtgagaaatccactctcacgaaactccacgcacgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggatacaaccccattcggccagcaaagggtttttaaagagaaagtggacaccaggacacccagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgtcgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactcttacagtggagtagaaggagaaggactgcataaactgggatacatcttaagagacatttccaagatacccggaggagctatgtatgctgatgacacagctggttgggacacaagaataacagaagatgacctgcacaatgaggaaaaaatcacacagcaaatggaccctgaacacaggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggcagacctcgagaaccctcacctgctagaaaagaaagttacacaatggttggaaacaaaaggagtggagaggttaaaaagaatggccatcagcggggatgattgcgtggtgaaaccaatcgatgacagattcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgactacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagaaggagccatttggtaa

SEQ ID NO: 7780 - RNA, 9873 nt, synthetic construct
  misc_feature 1..9873: note = derived and/or modified CDS sequence (wt) from DENV-3__AY744685__SS-prME
  source 1..9873: mol_type = other RNA
acatcgctctgtctcatgatgatgttaccagcaacacttgctttccatttgacttcacgggatggagagccgcgcatgattgtggggaagaatgaaagaggaaaatccctacttttcaagacagcctctggaatcaacatgtgcacactcatagccatggatttgggagagatgtgtgatgacacggtcacttacaaatgccccctcatcactgaagtggagcctgaagacattgactgctggtgcaaccttacatcgacatgggtgacctacggaacgtgcaatcaagctggagagcacagacgcgataagagatcggtggcgttagctccccatgtcggcatgggactagacacacgcacccaaacctggatgtcggctgaaggagcttggagacaggtcgagaaggtagagacatgggcctttaggcacccagggttcacaatactagccctatttcttgcccattacataggcacttccctgacccagaaagtggttattttcatactactaatgctggtcaccccatccatgacaatgagatgtgtgggagtgggaaacagagattttgtggaaggcctatcaggagctacgtgggttgacgtggtgctcgagcacggtgggtgtgtgaccactatggctaagaacaagcccacgttggatatagagctccagaagaccgaggccacccaactggcgaccctaaggaaactatgtattgagggaaaaattaccaatgtaacaaccgactcaaggtgtcccacccaaggggaagcgattttacctgaggagcaggaccagaactacgtgtgtaagcacacatacgtggacagaggctggggaaacggttgtggtttgtttggcaagggaagcctggtaacatgcgcgaaatttcaatgtttggaatcaatagagggaaaagcggtgcagcatgagaacctcaaatacaccgtcatcatcacagtgcacacaggagatcaacaccaggtgggaaatgaaatgcagggagtcacggctgagataacaccccaggcatcaaccgttgaagccatcttgcctgaatatggaacccttgggctagaatgttcaccacggacaggtctagatttcaatgaaatgattttgttgacaatgaagaacaaagcatggatggtacatagacaatggttttttgacctgcctttaccatggacatcaggagctacaacagaaacaccaacctggaataagaaagagcttcttgtgacattcaaaaacgcacatgcaaaaaagcaagaagtagtagtccttggatcgcaagagggagcaatgcacacagcactgacaggagctacagagatccaaacctcaggaggcacaagtatttttgcggggcacttaaaatgtagactcaagatggacaaattggaactcaaggggatgagctatgcaatgtgcttgaatgccttcgtgttgaagaaagaagtctctgaaacgcaacatgggacgatactcattaaggttgagtacaaaggggaagatgcaccttgcaagattcctttctccacggaggatggacaagggaaagcccacaacggcagactgatcacagctaacccaatagtgaccaagaaggaggagcctgtcaacatcgaggcagaacctccttttggggaaagtaacatagtaattggaattggagacaaagccttgaaaatcaactggtacaagaagggaagctcgattgggaagatgttcgaggccactgccagaggtgcaaggcgcatggccatcttgggagacacagcctgggactttggatcagtaggtggtgttttaaattcattaggaaaaatggtgcaccaaatatttggaagtgcttacacagccctatttagtggagtctcctggataatgaaaattggaataggtgtccttttaacctggatagggttgaattcaaaaaacgcttctatgtcattttcatgcattgtgataggaatcattacactatatctgggagctgtggtgcaagctgacatggggtgtgtcataaactggaaaggcaaagaactcaaatgtggaagtggaattttcgtcactaatgaggtccacacctggacagagcaatacaaatttcaagcggactctcccaaaagactggcgacagccattgcaggcgcttgggagaatggagtgtgcggaatcaggtcgacaaccagaatggagaacctcctgtggaagcaaatagctaatgaactgaactacatattatgggaaaacaacatcaaattaacgatagttgtgggtgatgtaattggggtcttagagcaggggaaaagaacactaacaccacaacccatggaactaaaatattcatggaaaacatggggaaaggcgaagatagtgacagctgaaacacaaaattcctctttcataatagacgggccaaacacaccagagtgtccaagtgccttaagagcatggaatgtgtgggaggtggaagattacgggttcggagttttcacaactaacatatggctgaaactccgagagaagtacacccaactatgtgaccacaggctaatgtcggcagccgttaaggatgagagggccgtacacgccgacatgggctattggatagaaagccaaaagaatggaagttggaagctagaaaaggcatccctcatagaggtaaaaacctgcacatggccaaaatcacacactctttggagcaatggtgtgctagagagtgacatgatcatcccaaagagtctggctggtcccatttcgcaacacaactacaggcccggataccacacccaaacggcaggaccctggcacttaggaaaattggagctggacttcaactattgcgaaggaacaacagttgtcatcacagaaaattgtgggataagaggcccatcactgaggacaacaacagtgtcagggaagttgatacacgaatggtgttgccgctcgtgtacgcttcctcccctgcgatacatgggagaagacggctgctggtatggcatggaaattagacccattaatgagaaagaagagaacatggtaaagtctttagtctcagcagggagtggaaagacggataacttcacaatgggtgtcttgtgtttggcaatcctctttgaagaggtgatgagaggaaaatttgggaaaaaacacatgattgcaggggctctcttcacgtttgtgctccttctctcagggcaaataacatggagagacatggcgcacacactcataatgattgggtccaacgcctctgacagaatgggaatgggcgtcacttacctagcattgattgcaacatttaaaattcagccatttttggctttaggattcttcctgaggaaactgacatccagagaaaatctattgctgggagttgggttggccatggcaacaacgttacaactgccagaggacattgaacaaatggcgaatggaatagctttagggctcatggctcttaaattaataacacaatttgaaacataccaactatggacggcattaatctccctaatgtgttcaaacacaattttcacgttgactgttgcctggagaacagccaccctgattttggccgtaatttctcttttgccagtgtgccagtcttcgagcatgaggaaaacagattggctcccaatgactgtggcagctatgggagttccacccctaccacttttcattttcagtttaaaagacacgctcaaaaggagaagctggccactaaatgagggggtgatggctgttggacttgtgagcattctagccagttctttccttaggaatgacgtgcccatggctggaccattagtggctgggggcttgctgatagcgtgctacgtcataactggcacgtcagcagacctcactgtagaaaaagcagcagatgtgacatgggaggaagaggctgagcaaacaggagtgtcccacaatttaatgatcacagttgatgacgatggaacaatgagaataaaagatgatgagaccgagaacatcttaacagtgcttttgaaaacagcattactaatagtgtcaggcatttttccatactccatacccgcaacactgttggtttggcacacttggcaaaagcaaacccaaaggtccggcgtcctatgggacgttcccagccccccagagacacagaaagcagaactggaagagggggtctataggatcaagcagcaaggaatttttgggaaaactcaagtgggagttggagtacaaaaagaaggagtttttcacaccatgtggcacgtcacaagaggagcagtgttgacacacaatgggaaaagactggaaccaaactgggctaacgtgaaaaaagatctgatttcatacggaggaggatggaaattgagtgcacaatggcaaaaaggagaggaagtgcaggttattgctgtagagcctgggaagaacccaaagaactttcaaaccatgccaggcatttttcagacaacaacaggggagataggagcgattgcactggacttcaagcctggaacttcaggatctcccatcataaacagagagggaaaggtagtggggctgtatggcaatggagtggtcacaaagaatggtggctatgtcagtggaatagcacaaacaaatgcagaaccagacggaccgacaccagagttggaagaagagatgttcaaaaagcgaaatctaaccataatggatctccatcccgggtcaggaaagacgcggaaatatcttccagctattgttagagaggcaatcaagagacgtttaaggactctaattttggcaccaacaagggtagttgcagctgagatggaagaagcattgaaagggctcccaataaggtatcagacaactgcaacaaaatctgaacacacagggagagagattgttgatctaatgtgccacgcaacgttcacaatgcgtttgctgtcaccagtcagggttccaaactacaacttgatagtaatggatgaggctcatttcacagacccagccagtatagcggctagagggtacatatcaactcgtgtaggaatgggagaggcagcagcaattttcatgacagccacaccccctggaacagctgatgcttttcctcagagcaacgctccaattcaagatgaagaaagagatataccagaacgctcatggaattcaggcaatgaatggattaccgactttgccgggaagacggtgtggtttgtccctagcatcaaagctggaaatgacatagcaaactgcttgcgaaaaaatggaaaaaaggtcattcaacttagtaggaagacttttgacacagaatatcaaaagactaaactgaatgattgggactttgtggtgacaacagacatttcagaaatgggagccaatttcaaagcagacagagtgattgacccaagaagatgtctcaagccagtgatcttgacagacggacccgagcgcgtgatcctggcgggaccaatgccagtcaccgtagcgagcgctgcacaaaggagagggagagtcggcaggaactcacaaaaagagaatgaccaatacatattcacgggccagccccttaataatgatgaagaccatgctcactggacagaagcaaaaatgctgttagacaacatcaacacaccagaagggatcataccagctctctttgaaccagaaagggagaagtcagccgccatagacggcgaataccgcctgaagggtgagtccaggaagaccttcgtggaactcatgaggaggggtgacctcccagtttggctagcccataaagtagcatcagaagggatcaaatacacagatagaaagtggtgttttgatggagaacgcaataatcaaattttagaggagaatatggatgtggaaatctggacaaaggaaggagagaagaaaaaattgagacctaggtggcttgatgcccgcacttattcagatccattagcgctcaaggaattcaaggactttgcggctggtaggaagtcaattgcccttgatcttgtgacagaaataggaagagtgccttcacacttagctcacagaacgagaaacgccctggacaatctggtgatgttgcacacgtcagaacatggcgggagggcctacaggcatgcagtggaggaactaccagaaacaatggaaacactcctactcctgggactcatgatcctgttaacaggtggagcaatgcttttcttgatatcgggtaaagggattggaaagacttcaataggactcatttgtgtagttgcttccagcggtatgttatggatggctgatgttccactccaatggatcgcgtcggccatagtcctggagtttttcatgatggtgttactaataccagaaccagaaaagcagagaactccccaagacaatcaactcgcatatgtcgtgataggcatacttacgttggctgcaatagtagcagccaatgaaatgggactgttggaaaccacaaagagagatttaggaatgtccaaagaaccaggtgttgtttctccaaccagctatttggatgtggacttgcacccagcatcagcctggacgttgtacgctgtggccacaacagtaataacaccaatgctgagacataccatagagaattccacagcaaatgtgtccctagcagctatagccaaccaggcagtggtcctgatgggtttagacaaaggatggccaatatcgaaaatggacttaggcgtaccactattggcactgggttgttattcacaagtgaatccactaactctcacagcggcagtactcctgctagtcacgcattatgctatcataggcccaggattgcaggcaaaagccactcgtgaagctcaaaaaaggacagctgctggaataatgaagaatccaacagtggatgggataatgacaatagacctagaccctgtaatatacgattcaaaatttgaaaaacaactaggacaggttatgctcctggttctgtgcgcagttcaacttttgttaatgagaacatcatgggctttttgtgaagctctaaccctagccacaggaccaataacaacactctgggaaggatcacctgggaagttctggaacaccacgatagccgtttccatggcgaacatatttagagggagctatttggcaggagctgggctcgctttttctatcatgaaatcagttggaacaggaaagagagggacagggtcacagggtgaaaccttgggagaaaagtggaaaaagaaattgaatcaattatcccggaaagagtttgacctttacaagaaatccggaatcactgaagtggatagaacagaagccaaagaagggttgaaaagaggagaaataacacaccatgccgtgtccagaggcagcgcaaaacttcaatggttcgtggagagaaacatggtcatccccgaaggaagagtcatagacttaggctgtggaagaggaggctggtcatattattgtgcaggactgaaaaaagttacagaagtgcgaggatacacaaaaggcggcccaggacatgaagaaccagtacctatgtctacatatggatggaacatagtcaagttaatgagtggaaaagatgtgttttatcttccacctgaaaagtgtgatactctattgtgtgacattggagaatcctcaccaagcccaacagtggaagaaagcagaaccataagagtcttgaagatggttgaaccatggctaaaaaataaccagttttgcattaaagtattgaacccttacatgccgactgtgattgagcacttagaaagactacaaaggaaacatggaggaatgcttgtgagaaatccactctcacgaaactccacgcatgaaatgtactggatatctaatggcacaggcaatatcgtttcttctgtcaacatggtatccagattgctactgaacagattcacaatgacacataggagacccaccatagagaaagatgtggatttaggagcggggacccgacatgtcaatgcggaaccagaaacacccaacatggatgtcattggggaaagaataagaaggatcaaggaggagcatagttcaacatggcactatgatgatgaaaatccttataaaacgtgggcttaccatggatcctatgaagttaaggccacaggctcagcctcctccatgataaatggagtcgtgaaactcctcacgaaaccatgggatgtggtgcccatggtgacacagatggcaatgacggacacaaccccattcggccagcaaagggtttttaaagagaaagtggacaccaggacacctagacccatgccaggaacaagaaaggttatggagatcacagcggaatggctttggagaaccctgggaaggaacaaaagacccagattatgtacgagagaggagttcataaaaaaggtcagaaccaacgcagctatgggcgccgtttttacagaggagaaccaatgggacagtgctagagctgctgttgaggatgaagaattctggaaactcgtggacagagaacgtgaactccataaattgggcaagtgtggaagctgcgtttacaacatgatgggcaagagagagaagaaacttggagagtttggcaaagcaaaaggcagtagagccatatggtacatgtggttgggagccaggtaccttgagttcgaagcactcggattcttaaatgaagaccattggttctcgcgtgaaaactctcacagtggagtagaaggagaaggattgcataaactgggatacatcttaagagacatttccaagatacccggaggagctatgtatgctgatgacacagctggttgggacacaagaataacagaagatgacctgcacaatgaggaaaaaatcacacagcaaatggatcctgaacataggcagttagcaaacgctatattcaagctcacataccaaaacaaagtggtcaaagttcaacgaccaactccaaagggcacggtaatggacatcatatctaggaaagaccaaagaggcagtggacaggtgggaacttatggtctgaacacattcaccaacatggaagcccagttaatcagacaaatggaaggagaaggtgtgttgtcgaaggctgacctcgagaaccctcacctgctagagaagaaagttacacaatggttggaaacaaaaggagtggagaggttaaaaagaatggccatcagcggggatgattgcgtggtgaaaccaatcgatgacaggttcgccaatgccctgcttgccctgaatgacatgggaaaagttaggaaggacatacctcaatggcagccatcaaaaggatggcatgattggcaacaggtccctttctgctcccaccactttcatgaattgatcatgaaagatggaagaaagttggtagttccctgcagaccccaggatgaattaatcgggagagctagaatctctcaaggagcaggatggagcctcagagaaactgcatgcctagggaaagcctacgctcaaatgtgggctctcatgtactttcacagaagagatcttagactagcatccaacgccatatgttcagcagtaccagtccattgggtccctacaagcagaacgacgtggtctattcatgctcaccatcagtggatgaccacagaagatatgcttactgtttggaacagggtgtggatagaggacaatccatggatggaggacaaaactccagtcacaacctgggaagatgttccatatctagggaagagagaagaccaatggtgcggatcactcattggtctcacttccagagcaacctgggcccagaacatacttacggcaatccaacaggtgagaagccttataggcaatgaagagtttctggactacatgccttcaatgaagagattcaggaaggaggaggagtcagagggagccatttggtaa

SEQ ID NO: 7781 - RNA, 9873 nt, synthetic construct
  misc_feature 1..9873: note = derived and/or modified CDS sequence (wt) from DENV-3__AY876494__SS-prME
  source 1..9873: mol_type = other RNA
acatcgctctgtctcatgatgatgttaccagcaacacttgctttccacttgacttcacgtgatggagagccgcgcatgattgtggcgaagaatgaaagagggaaatccctactttttaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacatatggaacgtgcaatcaagctggggagcatagacgcgacaagagatcagtggcgttagctccccatgtcggcatgggactggacacacgcacccaaacctggatgtcggctgaaggagcttggagaccagtcgagaaggtagagacatgggctcttaggcacccaggtttcaccatactagctctatttcttgctcattacataggcacttccctgacccagaaagtggttatttttatactactaatgctggtcactccatccatgacaatgagatgcgtgggagtgggaaacagagattttgtggaaggtctgtcgggagctacgtgggttgacgtggtgctcgagcacggtgggtgcgtgactaccatggctaagaacaagcctacgctggacatagagcttcagaagaccgaggccacccaactggcgaccctaaggaagttatgcattgagggaaaaattaccaacgtaacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgctgaagctatcttgcctgagtatggaacccttgtgttagaatgctcaccacggacaggtttggatttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagttaaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctctggagcaatggtgtactagagagtgacatgatcatcccaaagagtctagctggtcctatttcacaacacaaccacaggcccgggtactacacccaaacggcaggaccttggcacttgggaaaattggagctggacttcaactattgtgaaggaacaacagtagtcatcacagaaaactgtgggacaagaggcccatcattgagaacaacaacagtgtcagggaagttgatacacgaatggtgttgccgctcgtgcacacttcctcccttgcgatacatgggagaggacggctgctggtatggcatggagattagacctatcaatgagaaagaagagaacatggtaaagtctttagtctcagcagggagtggaaaggtggacaactttacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggacgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcctatggctggaccactagtggccgggggcttgttgatagcgtgctatgtcataactggcacgtcagcagacctcaccgtagaaaaagcagcagatgtgacatgggaggaagaggctgagcaaacaggagtgtcccacaatttgatgatcacagttgatgatgatggaacaatgagaataaaggatgatgagactgagaacatccctacagtgctcttaaaaacagcattactaatagtttcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgccgaagcctttcctcagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgggtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggcgagtccaggaagaccttcgtggaactcatgaggaggggtgacctcccagtttggctagcccataaagtagcatcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttactcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacagagaactccccaagacaaccaacttgcatatgtcgtgataggcatacttacactggctgcgatagtagcagccaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtgccgctactggcactgggctgctattcacaagtgaacccactgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggacctataacaacactctgggaaggatcacctggaaagttttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagctaatgagtggaaaggacgtgttttatcttccacctgaaaagtgtgacaccctattgtgtgacattggagaatcttcaccaagcccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggtgcccatggtgacacagatggcaatgacagatacaactccatttgggcagcaaagagttttcaaagagaaagtggacaccaggacacccaggcccatgccagggacaagaaaggttatggagatcacggcggaatggctttggagaaccctgggaaggaacaaaagacccagattgtgcacaagggaagagttcacaaaaaaggtcagaaccaacgcggctatgggagctgttttcacagaggagaaccaatgggatagtgcgagagctgctgttgaggacgaggaattctggaacttgtgggacagagaacgtgaactccacaaattaggcaagtgtggaagctgcgtctacaacatgatgggcaagagggagaagaaacttggagagtttggcaaagcaaaaggcagtagagctatatggtacatgtggttgggagccaggtaccttgagttcgaagcactcggttttttaaatgaagaccactggttctcgcgtgaaaactcttacagtggagtagaaggagaaggactgcacaagctgggatacattttaagagacatttctaagatacccggaggagctatgtatgctgatgacacagctggttgggacacaagaataacagaagatgacctgcacaatgaggaaaaaatcacacagcaaatggatcctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagctcagttagtcagacagatggaaggagaaggcgtgttgtcgaaggcagacctcgagaaccctcatctgctagagaagaaaatcaccccatggttggaacccaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagatcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7782 - RNA, 9873 nt, synthetic construct
  misc_feature 1..9873: note = derived and/or modified CDS sequence (wt) from DENV-3__AY923865__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttatggaacgtgcaatcaagctggggagcacagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagaacaagcctacgctggacatagagcttcagaagaccgaggccacccaactggcgaccctaaggaagttatgcattgagggaaaaattaccaacataacaactggctcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaacctcaaatacactgtcatcatcacagtgcacacaggagaccaaccccaggtgggaaatgacacgcagggagtcacggttgagataacaccccaggcatcaaccgttgaagctgtcttgcttgaatatggaacccttgggctaaaatgctcaccacggacaggcttggatttcaatgaaatgattttattgacaatgaagaccaaagcctggatggtacataggcaatggttctttgacctacccctaccatggacatcaggagctacaacagagacaccaacttggaacaggaaagagcttcttgtaacattcaaaaatgcacatgcgaaaaagcaagaagtagttgtccttggatcacaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggctgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaaatctttagtctcagcagggagtggaaaagtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggatgtacccagccccccagaaacacagaaagcagaactggaagagggggtctataggatcaaacaacaaggcatttttgggaaaacccaagtgggggttggagtgcagaaagaaggagtcttccacaccatgtggcacgtcacaagaggggcagtgttgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtaggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgaaatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcagaagaccagactgaatgattgggacttcctggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaagaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatacttacactggctgcgatagtagcagctaatgaaatgggattactggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctacttagcaggaactgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacattgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagacacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagtccaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7783 - RNA, 9867 nt, synthetic construct
  misc_feature 1..9867: note = derived and/or modified CDS sequence (wt) from DENV-4__KR922405__SS-prME
  source 1..9867: mol_type = other RNA
tcaacaataacattgctgtgcttgattcccactgtaatggcgtttcacttgtcaacgagagatggtgaacccctcatgatagtggcgaaacacgaaagggggagacctctcttgtttaagacaacagaaggaatcaataagtgcactcttattgccatggacctgggtgagatgtgcgaggacaccgtcacgtataaatgccccttactggtcaataccgaacccgaggacattgattgctggtgcaatctcacgtctgcctgggttatgtatgggacatgcacccaaagtggagaacgaaggcgagagaagcgctcagtagctctaacaccacattcaggaatgggattggaaacaagggctgaaacatggatgtcatcggaaggagcttggaaacacgcccagagggtagagagttggatactcagaaacccaggattcgcgctcttggcagggtttatggcctacatgatcgggcaaacaggaatccagcgaacagtcttcttcattctaatgatgttggtcgccccatcttacggaatgcgatgcgtgggagtagggaacagagactttgtagaaggagtctcaggtggagcatgggtcgatctggtgctggaacatggaggatgtgtcacaaccatggcccagggaaagccaaccttggattttgaactgatcaagacaacagccaaggaagtggccctgttaagaacctattgcattgaagcttccatatcaaacataaccacggcaacaagatgtccaacgcaaggagagccttacctcaaagaggaacaagatcaacagtacatctgccggagagacatggtagatagagggtggggcaacggctgtggcttgtttgggaagggaggagttgtgacatgtgcgaagttctcatgcttggggaagataacgggcaacttagttcaaattgagaaccttgaatacacagtggttgtaacagtccacaatggagacacccacgctgtaggaaatgacacatctaaccatggagtgacagccacgataacccccaggtcaccatcggttgaagttaaattaccggactatggagaattgacacttgactgtgaacctaggtccggaattgacttcaatgagatgattctgatgaaaatgaaaacgaaaacgtggctcgtgcacaagcaatggtttttggatctacctctaccatggacaacaggagcagacacgttagaagttcactggaatcacaaagagagaatggtgacattcaaggttcctcatgccaagagacaggatgtgacagtgctaggatctcaggaaggagccatgcattcagccctcgccggagccacagaagtggattccggtgatggaaaccatatgtttgcaggacacttaaagtgtaaagttcgtatggaaaagttgaggatcaagggaatgtcatacacgatgtgctcaggaaagttctcaattgataaagagatggcagaaacacagcatggaacaacagtggtaaaggtcaagtatgaaggtactggagctccatgtaaagttcccatagagataagagatgtgaacaaggaaaaagtggttgggcgcatcatctcatccaccccttttgctgagaacaccaacagtgtgaccaatatagaattggaacctccttttggggatagctacatagtgataggtgtgggagacagtgcattaacactccattggttcaggaaagggagctccattggcaagatgtttgagtccacatacagaggtgcaaagcgcatggccattctaggtgaaacagcttgggattttggttccgttggtggactgcttacgtcattgggaaaggctgtacaccaggtttttggcagtgtgtacacaactatgtttggaggagtctcatggatggtcagaatcctaatcggactcttagtgttgtggattggtacgaattcaagaaacacttcaatggctatgtcgtgcatagctgttggaggaatcaccctgtttttgggcttcacagtccatgcagacatgggttgtgtggtgtcatggagtgggaaagagttgaaatgtggaagcggaatctttgtaattgacaacgtgcacacttggacagaacagtacaaatttcaaccagagtctccagcgcgactggcgtcggcaatactgaatgcccacaaagaaggggtctgtggaattagatcaaccacgaggctggaaaatgtcatgtggaagcaaataaccaatgagttaaactatgttctctgggaaggaggacatgacctcactgtagtggccggggatgtgaaaggggtgttgtccaaaggcaagagagcactcgcacctccagtgaatgacctgaaatattcatggaagacatgggggaaagcgaagatctttactccagaaacaagaaacagcacatttttggtggacggaccagacacctccgaatgccccaatgaacgaagagcatggaactttcttgaggtggaagactatggatttggcatgttcacgaccaacatatggatgaaatttcgagaaggaagttcagaagtgtgtgaccataggctgatgtcagcagcaatcaaagaccagaaagctgtgcatgctgatatgggctattggatagagagctcaaaaaaccagacctggcagatagaaaaggcatccctcatagaagtgaaaacatgtctgtggcccaagacccacacattgtggagcaatggagtgctggaaagccagatgctcatcccaaaagcatatgcaggccctatttcacagcacaactatcgccagggctatgccacgcagaccgcgggcccatggcacttgggcaaattggagatagactttggagaatgccctggaacaacagtcactatacaagaggattgtgaccatagaggcccatctttgaggaccaccactgcatctggaaaattggtcacgcagtggtgctgccgctcctgcacgatgcctcccttaagatttttaggagaggatggatgctggtatgggatggaaatcaggcccttgaatgaaaaagaggagaacatggtcaaatcacaggtatcagccggacagggtacatcagagaccttttctatggggctgttgtgcctgactttgtttgtggaagaatgcttgaggagaagagtcaccaggaaacacatgatattggttgtggtgaccaccctttgtgccatcattttaggaggtctcacatggatggacttactgcgtgcccttatcatgctaggagacaccatgtctggtagaatggggggacagattcatctagccatcatggcagtgttcaagatgtcaccaggatacgtgttgggtatatttctgaggaaactcacctcaagagagacagcactgatggtaataggaatggccatgacaacggtgctctcaattccacatgaccttatggaatttattgatggaatatcattagggttaatcttattaaaaatggtaacacattttgacaacactcaagtgggaaccttagcccttgccttgaccttcataaaatcaacaatgccattggtcatggcttggaggaccataatggctgtgttgtttgtggtcacactcattcctctatgtaggacaagctgtcttcaaaagcagtcccattgggtggaaataacagcactcatcctgggagcccaggctctgccagtatacctaatgactctcatgaaaggagcctcaaaaagatcttggccccttaacgagggtataatggctgtgggcttggtcagtctcttaggaagcgcccttctaaagaatgatgtccctttagctggcccaatggtggcaggaggcttacttctggcagcctacgtgatgagcggcagctcagcagacctgtcactagagaaggctgccaatgtgcagtgggatgagatggcagacataacaggctcaagcccaatcatagaagtgaagcaggatgaagatggctctttctccatacgggacgtcgaggaaaccaacatgattaccctcctggtgaaactggcgctgataacagtgtcaggtctctaccccttggcaattccagtcacaatgaccctatggtacatgtggcaagtgaaaacacaaagatcaggagccctgtgggacgttccctcacctgctgccgctcagaaagctacactgactgagggagtatacaggatcatgcaaagagggttgtttgggaaaacccaggttggagtagggatacacacggaaggtgtgtttcatacaatgtggcatgtaacaagaggatcagtgatttgccatgagagtgggagactggagccatcttgggctgacgtcaggaacgacatgatatcatatggtgggggatggaggctcggagacaaatgggacaaagaagaagatgttcaagttctagctatagaaccaggaaaaaatccgaaacatgtccaaacgaaacccggcctttttaaaacccttactggagaaattggagcagtaacattggacttcaaacccggaacatccggttctcccatcattaacaggaaaggaaaagtcatcggactctacggaaatggggtagttaccaaatcaggtgattacgttagtgccataacacaagctgaaagaattggtgagccagactatgaagtggatgaggacattttccgaaagaaaagattaactataatggatttacatcccggagccggaaagacaaaaagaatcctcccatcaatagttagagaagccttaaaaaggaggctgcgaaccttgattctggctcccacgagagtggtggcggccgaaatggaagaagcgctacgtggactgccaatccgttatcagaccccagctgtgaaatcagaacacacaggaagagagatcgtagacctcatgtgtcatgcaacctttacaacaagacttttatcatcaaccagggttccaaattacaacctcatagtgatggatgaagcgcatttcacagacccttctagcgttgcagctagaggatatatctcaaccagggtggaaatgggagaggctgcagctatctttatgactgcaacccctcctggaacgacagatcccttcccccagagcaacagcccaatagaagacatcgagagagaaatcccagaaaggtcatggaacacagggtttgactggataacggactaccaagggaaaactgtgtggtttgttcccagcataaaggctggaaatgacattgcaaattgcttgagaaaatcgggaaagaaggtcatccaattgagcaggaaaaccttcgacacagagtatccaaaaacgaaactcacggactgggattttgtggttaccacagacatatctgaaatgggggccaattttagagctgggagagtgatagaccccaggagatgcctcaagccagttatcttaactgatgggccggagagagttattttagctggtcccattccagtgactccagcaagcgctgctcagagaagagggcgaataggtaggaacccagcacaagaagatgaccagtatgtcttctccggagacccactaaggaatgatgaggatcatgcccactggactgaagcaaagatgcttcttgataatatctacactccagaagggatcatcccaacactgtttggtccagaaagggaaaaaacccaagccattgacggagagttccgcctcagaggggaacaaaggaagacctttgtagaattaatgaggaggggagaccttccggtgtggctgagctacaaggtagcttctgctggtatctcttacaaagaccgggaatggtgcttcacgggggaaaggaataaccaaattttggaagaaaacatggaggttgaaatttggactagagagggagagaagaaaaaactcaggccaaaatggttagatgcacgtgtttacgctgatcccatggctttgaaggatttcaaggagtttgccagtggaagaaagagtataaccctcgacatcttgacagaaattgccagtttgccaatgtacctttcctccagggctaagctcgcccttgacaacatagtcatgctccatacaacagaaagaggagggaaggcctaccaacacgctctgaacgaactcccagagtcactagaaacactcatgcttgtagctttattaggagccatgacagcaggcatcttcctattcttcatgcaaggaaaaggaataggaaaattgtcaatgggtttgatagccattgcggtagctagtggcttgctctgggtggcagaaatccagccccaatggatagcggcctcaatcatattggagttttttctcatggtgctgttggtaccagaaccagaaaaacaaaggaccccacaagacaatcaattgatctacgtcatattgaccattctcactattattgctctcgtggcagccaatgagatggggctaattgaaaaaacaaaaacggattttgggttttaccaggtgaaagcagaaaccaccatccttgatgtggatctaagaccagcttcagcatggacgctctatgcagtagctaccactatcttgactcccatgctgaggcacaccatagaaaacacgtctgcaaacttatccttggcggccattgccaaccaagcagccgtcttgatggggcttggaaaaggatggccgctccacagaatggacctcggtgtgccgctattggcaatgggatgctattcccaagtgaacccaacaactttaacagcatccttagtcatgcttctggtccattatgcaataataggtccaggattgcaggccaaagccacaagagaggctcaaaaaaggacagctgctgggatcatgaagaatcccacagtggacgggataacagttatagatctagaaccaatatcctatgacccaaaatttgagaaacagctagggcaagtcatgctactagttctgtgcgctggacagctactcttgatgagaacaacatgggccttttgtgaagtcctgactttggccacaggaccaatcttgaccttgtgggaaggcaacccgggaaggttttggaacacgacaatagccgtgtccactgccaacattttcaggggaagctacttggcgggagctggattggccttttcgctcataaagaatgcacaaacccccaggaggggaactgggaccacaggagagacactgggagaaaaatggaagagacagctaaactcgctagataggaaggagtttgaagagtacaaaagaagtggaatactagaagtggacaggactgaagccaagtctgccctaaaagatgggtccaaaatcaagttcgcagtgtccagagggaccagcaagattagatggattgttgaaagagggatggtaaagccaaaagggaaagttgtggatcttggttgcggaagaggaggatggtcgtactatatggcgacactcaagaacgtgaccgaggtgaaagggtacacaaaaggaggtccaggacatgaggaaccggttcccatggcgacctatggctggaacttggtcaaactccattcaggggttgacgtgttctacaaacccactgagcaagtggacactctgctctgtgatattggggagtcatcctctaatccgaccatagaggaaggaagaacattacgagttttaaaaatggtggagccatggctctcttcaaaacctgaattctgcatcaaagtcctcaatccttacatgccaacagtcatagaggagctggagaaactgcagagacgacatggtggaagccttgtcagatgcccactatccaggaattccactcatgagatgtattgggtgtcaggtgtgtcaggaaacatcgtgagttctgtgaacacaacatcaaagatgttgttgaacagatttaccacaaggcacaggaaacccacttatgagaaggacgcagaccttggagcaggaacgagaagtgtctccaccgaaacagaaaaaccagacatgacaatcatcgggagaagactccagcgattgcaagaggagcacaaagaaacttggcactatgatcatgaaaatccatacagaacctgggcgtatcatggaagctatgaagctccttcgacaggctcagcatcctccatggtgaacggggtagttaaactgctgacaaaaccctgggacgtggttccaatggtgacccagttggctatgacagatactaccccctttgggcaacagagagtgttcaaggagaaggttgacaccagaacaccgcagccaaaacccggtacacgagtaatcatgaccacgacagccaactggctgtggactctcctcgggaggaagaaaaatcccagactgtgcacaagggaagaattcatctcaaaagtcaggtcaaatgcagccataggcgcagtctttcaggaagaacagggatggacatcagccagtgaagcagtgaatgacagccgattttgggaactggttgacaaagaaagggctctgcaccaggaagggaaatgtgaatcatgtgtctataacatgatgggaaaacgtgaaaagaaactaggagaatttggcagagccaaggggagccgagcaatctggtacatgtggctgggagcgcggtttctggaatttgaagccctgggctttttgaatgaagatcactggtttggcagggaaaactcatggagtggagtggaaggggaaggtctgcataggttgggatacatcttggaggacatagacaagaaggatggagatctgatatatgctgatgacacagcaggctgggacacaagaatcactgaagatgaccttctgaatgaagagctgatcacggaacagatggcccctcatcataaaatcctagctaaagccattttcaaactaacttatcaaaacaaagtagtgaaagtcctcagacctacaccgaaaggagcagtgatggacattatatccaggaaagatcaaagaggtagtggacaggttggaacatatggtttgaacacattcaccaacatggaagtacaactcatccgccaaatggaagctgaaggagtcattacacaagatgacatgcataacccaaaagggttgaaggaaagagttgagaaatggctgaaagagtgtggtgtcgacaggttaaagaggatggcaattagtggagatgattgtgtggtaaagcctctagatgagaggttcagcacttccctcctctttttgaacgacatgggaaaggtgaggaaagacattccgcaatgggaaccatccaagggatggaaaaactggcaagaggttcctttttgctcccaccattttcacaagatctttatgaaggatggccgttcactagtcgttccatgtagaaaccaggatgaactgatagggagagccagaatctcgcaaggggctggatggagtttaagagaaacggcctgtctgggcaaagcttacgcccagatgtggtcgctcatgtactttcatagaagggacctacgtttagcctctatggctatatgctcagcagtcccaacggaatggttcccaacaagcagaacaacatggtcaatccacgctcatcatcagtggatgactactgaagatatgctaaaagtgtggaacagagtgtggatagaagacaaccctaatatgattgacaaaactccagttcactcgtgggaagacataccctacctagggaaaagagaggatttgtggtgtggatccttgattggactctcttccagggccacctgggctaagaacattcacacagccataacccaggtcaggaacctgatcgggaaagaggaatatgtggattacatgccagccatgagaagatacagcgctcatttcgagagtgaaggagttctgtaa

SEQ ID NO: 7784 - RNA, 9867 nt, synthetic construct
  misc_feature 1..9867: note = derived and/or modified CDS sequence (wt) from DENV-4__KP188557__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgttagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtggatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggggttacagccacgataactcccaggtcaccatcggttgaagtcaaattgccggactatggagaactaacactcgattgtgaacctaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaagaatcttcacccctgaagcaagaaacaacacatttttaatagacggaccagatacctctgaatgccccaatgaacgaagagcatggaattcttttgaggtggaagactatgggtttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggagagccagatgcttattccaaaatcatatgcaggccctttttcacagcacaattaccgccagggctacgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatgttgggggacactatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactggagaaggccgctaatgtgcggtgggatgaaatggcagacataacaggctcaagtccaatcatagaagtgaagcaagatgaggatggctctttctccatacgggacgttgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtggaaatgggagaggcagcagccatctttatgaccgcaacccctcccggagcgacggatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgcgccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttggaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattatcaatgggtttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggacctcggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagattagatggatcgttgagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctagagaaactgcagagaaaacatggtgggaaccttgtcagatgcccgctgtccaggaactccacccatgagatgtactgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattggaagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgctcagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7785 - RNA, 9867 nt, synthetic construct
  misc_feature 1..9867: note = derived and/or modified CDS sequence (wt) from DENV-4__KP188558__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacgatggagacacccatgcagtaggaaatgacacatccaatcatggggttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttagatctgcctcttccatggacgacaggagcagatacatcagaggttcactggaattacaaagagagaatggtgacattcaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatgttgggggacactatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatatcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtggaaatgggagaggcagcagccatcttcatgaccgcaacccctcccggagcgacggatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtgaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggctgccgtcctaatggggcttggaaaaggatggccactccacagaatggacctcggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacgctgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagattagatggatcgttgagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaaaatgttgttgaacaggttcacaacaaggcacaggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggctgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7786 - RNA, 9867 nt, synthetic construct
  misc_feature 1..9867: note = derived and/or modified CDS sequence (wt) from DENV-4__KP188563__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggggttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcactctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggtaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttatggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttctctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatgttgggggacactatgtctggcagaataggaggacagacccacctagccatcatagcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcattgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacagagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtagaaatgggagaggcagcagccatcttcatgaccgcaacccctcccggagcgacggatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttaaaggatttcaaggagtttgccagtgggaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggaccttggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactagtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggaccgaagccaagtccgccctgaaagatgggtccaaaatcaagcatgcagtatctagagggtccagtaagattagatggatcgttgagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaatagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggagctggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggttcggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgtcagtaatgaaaagatacagtgctccttcagagagtgaaggagttctgtaa

SEQ ID NO: 7787 - RNA, 9867 nt, synthetic construct
  misc_feature 1..9867: note = derived and/or modified CDS sequence (wt) from DENV-4__KP188564__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaataaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacacctcattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatagcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgtcgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggggttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcacgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatatacgatgtgttcaggaaagttttcaattgacaaagagatggcagaaacacagcatgggacaacagtggtgaaaatcaagtatgaaggtgctggagctccgtgtaaagtccccatagagataagagatgtaaacaaggaaaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcatcaggtttttggaagtgtgtatacaaccatgtttggaggagtctcatggatgattagaatcctaattgggttcttagtgttgtggattggcacgaactcaaggaatacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagattatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgttggagagccagatgcttattccaaaatcatatgcaggccctttttcacagcacaattaccgccagggctatgctacgcaaaccgtgggtccatggcacttaggcaaactagagatagactttggagagtgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctattgtgcctgaccttgtttgtggaagaatgcttgagaagaagagtcaccagaaaacacatgatattagctgtggtaatcactctttgtgctatcatcctggggggcctcacatggatggacttgctacgagccctcatcatgttgggggataccatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctctcaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaagaatcccaaacatgtccaaacgaaacctggccttttcaagaccctaactggagaaattggagcagtaacattggatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaaccataatggacttacaccctggagctggaaagacaaaaagaattcttccatcaatagtgagagaagccttaaaaaggaggctgcgaactttgattttggctcccacgagagtagtggcggctgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgactagggtggaaatgggagaggcagcagccatcttcatgaccgcaacccctcccggagcaacggatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtctgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaaaccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggacctcggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttaatgagaacaacatgggctttctgtgaagtcttgactttggctacaggaccaaccttgaccttgtgggaaggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagatcagatggatcgttgagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctataaacccacagagcaagtggacactctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccaatgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaagaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtactttcacagaagggatctgcgtttagcctccatggctatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7788 - RNA, 9867 nt, synthetic construct
  misc_feature 1..9867: note = derived and/or modified CDS sequence (wt) from DENV-4__JN983813__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataaccacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggggttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatgttgggggacactatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaatattgctaaaaatagtaacacagtttgacaacacccaagtgggaaccttagctctttccttgactttcataagatcaacaatgtcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttatttgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacatcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtggacctcatgtgccatgcaaccttcacaacaagacttttgtcatcaaccagagttccaaactataaccttatagtaatggatgaagcacatttcaccgatccttccagtgtcgcggctagaggatacatctcgaccagggtggaaatgggagaggcagcagccatcttcatgaccgcaacccctcccggagcgacggatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcctagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggacctcggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagattagatggatcgttgagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7789 - RNA, 9867 nt, synthetic construct
  misc_feature 1..9867: note = derived and/or modified CDS sequence (wt) from DENV-4__KF041260__SS-prME
  source 1..9867: mol_type = other RNA
tcaacaataacattgttgtgcttgattcccaccgtaatggcgtttcacttgtcaacgagagatggcgaaccccttatgatagtggcgaaacacgaaagggggagacctctcttgtttaagacaacagaaggaatcaacaagtgcactctcattgctatggacctgggtgaaatgtgcgaggacaccgttacgtataaatgccctctgctggttaacactgaacctgaagacattgattgctggtgtaatctcacgtctgcctgggtcatgtatgggacatgcacccaaagtggggaacggagacgagagaagcgctcagtagctctaacaccacattcaggaatgggactggaaacaagggctgaaacatggatgtcatcggaaggagcttggaaacacgcccagagggtagagagttggatactcagaaacccaggattcgcgctcttggcaggatttatggcctatatgattgggcaaacaggaatccagcggacagtcttctttattttaatgatgctggtcgctccatcctacggaatgcgatgtgtaggagtggggaacagagactttgtggaaggagtctcaggtggagcatgggtcgatctggtgctagaacatggaggatgtgtcacaaccatggcccagggaaaaccaaccttggattttgaactgatcaagacaacggctaaggaagtggctctgttaagaacctattgcattgaagcctccatatcaaacataaccacggcaacaagatgtccaacgcaaggagagccctacctcaaagaggaacaagatcaacagtacatctgccggagagacgtggtagacagagggtggggcaatggctgtggcctgtttgggaaaggaggagttgtgacatgtgcgaagttttcatgctcggggaagataacaggcaacttaatccaaattgagaacctagaatacacagtggttgtaacagtccacaatggagacacccatgcagtaggaaatgacacatccaaccacggagtgacagccacggtaacccccaggtcaccatcggtagaagttgaattgccggactatggagaattgacactcgattgtgagcccaggtccggaattgactttaatgagatgattctgatgaaaatgaataagaaaacgtggcttgtgcacaagcaatggtttttggatctacctctaccatggacagcaggagcagacacgtcagaagttcattggaatcacaaagaaagaatggtgacgtttaaggtccctcatgccaagagacaggatgtgacagtgctaggatctcaggaaggagccatgcattcagccctcaccggagccacagaagtagattccggtgatggaaaccacatgtttgcaggacatttgaaatgcaaagttcgcatggagaaattgaggatcaagggaatgtcatacacgatgtgctcaggaaagttctcaattgataaagagatggcagaaacacagcatgggacaacagtggtaaaagtcaagtatgagggtgctggagctccatgcaaagttcccatagagataagagatgtgaacaaggaaaaagtggttgggcgtatcatctcatctactccttttgctgagaataccaacagtgtgaccaatatagaattggaacccccctttggggatagctacatagtaataggtgtaggagacagcgcactgacacttcattggttcaggaaagggagttccatcggtaagatgtttgagtccacatacagaggcgcaaagcgcatggccattctaggtgaaacagcttgggattttggttctgttggtggactgctcacatcattgggaaaggctgtacaccaagtttttggtagtgtgtatacaactatgttcggaggagtctcatggatggttagaattctaattgggttcttagtgttgtggattggcacgaattcaagaaacacctcaatggcaatgtcatgcatagctgttggagggattactttgtttctgggtttcacagtccatgcagacatgggttgtgcggtgtcatggagtgggaaagaattgaagtgtggaagcggaatctttataattgacaacgtgcacacttggacagaacagtacaagttccaaccagagtcaccagcgagactagcgtctgcaatactgaatgcccacaaagatggggtctgtggaattagatcaaccacgaggttggaaaatgtcatgtggaagcaaataaccaatgagttaaactatgtgctctgggaaggaggacatgacctcactgtagtggccggggacgtgaaaggggtgttatccaaaggcaagagagcattagcacctccagtgaatgatttgaaatattcatggaagacatggggaaaagcaaagatcttcactccagagacaagaaacagcacatttttaatagacggaccagacacttccgaatgtcccaatgaacgaagagcatggaattttcttgaggtagaagactatggatttggcatgttcacgaccaacatatggatgaaatttcgagaaggaagttcagaagtgtgtgaccataggttgatgtcggcggcaatcaaagaccagaaagctgtacatgctgatatgggctactggatagagagctcaaaaaaccagacctggcagatagagaaggcatccctcattgaagtgaaaacatgtctgtggcccaagacccacacattgtggagtaatggagtgctggaaagtcagatgctcatcccgaaagcatatgcaggccctttttcacagcacaattaccgtcagggctacgccacgcagaccatgggcccatggcacttgggaaaattggagatagactttggagaatgccccggaacaacagtcaccattcaagaggattgtgaccatagaggcccgtctttgaggaccaccactgcatctgggaaactggtcacgcagtggtgctgccgctcctgcacgatgcctcccttaaggtttttaggagaggatggatgttggtatgggatggaaattaggcccttgagtgaaaaagaagagaacatggttaaatcacaggtgtcggccggacagggcacatcagaaactttctccatggggctgttgtgcctgactctatttgtggaagaatgcttgaggagaagagtcaccaggaaacacatgatattggttgtggtgaccaccctttgtgccatcatcttaggaggtctcacatggatggatttactgcgagcccttatcatgctagggaacaccatgtctagtagaatgggaggacagactcacctagccatcatggcagtgtttaaaatgtcaccaggatacgtgctgggtatatttttgaggaaactcacctcaagagagacagcactaatggtgataggaatggccatgacaacggtgctttcaattccacatgaccttatggaattcattgatggaatatcactagggttgatcttgttaaagatggtaacacattttgacaacactcaagtaggaaccttagccctttccttgaccttcataaaatcaacaatgccattggtcatggcttggaggaccataatggcggtgttgtttgtggtcacactcattcctctatgcaggacaagctgtcttcagaagcagtcccattgggtggaaataacagcactcatcctgggagcccaggctctgccagtatacctaatgactctcatgaaaggagcctcaaagagatcttggccccttaacgaaggtataatggctgtgggcttggtcagtctcttaggaagcgcccttctaaagaatgatgtccctctagctggcccaatggtggcaggaggcttgcttctggcagcctacgtgatgagcggtagctcagcagacctgtcactagaaaaggctgctactgtgcagtgggatgagatggcagacataacaggctcaagcccaatcatagaagtgaagcaggatgaagatggctctttctccatacgggacgtcgaggaaaccaacatgataaccctcctggtgaaactggcactgataacagtgtcaggtctctaccccttggcaattccagtcacaatgaccctatggtacatgtggcaagtgaaaacacaaagatcaggagccctgtgggacgtcccctcacctgctgccacccagaaagccacactgactgaaggagtgtacaggatcatgcaaagagggttatttgggaaaactcaggttggagtagggatacacatggaaggtgtgtttcacacaatgtggcatgtaacaagaggatcagtgatttgccatgagagtgggagactggagccatcttgggctgacgtcaagaatgacatgatatcatacggtgggggatggaggctcggagacaaatgggataaagaagaagacgttcaagttctggctgtagaaccagggaaaaatccaaaacatgtccaaacgaaacccggccttttcaaaaccctaactggagaaattggagcggtgacattggacttcaaacccggaacatccggttctcccatcatcaataggaaaggaaaagtcattggactttacggaaatggggtagttaccaaatcaggtgattacgtcagtgccataacacaagctgaaagaattggcgaaccagattatgaagtggatgaggacatctttcgaaagaaaagattgaccataatggacttacaccccggagccggaaagacaaaaagaattcttccatcaatcgttagagaagctttaaaaaggaggctacgaaccctgattctggcacccacgagagtggtagcggccgaaatggaagaagccctacgcggactgccaatccgttaccagaccccagctgtgaaaacagaacacacaggaagggagatcgtggacctcatgtgccatgcaaccttcacaacaagacttttatcatcaaccagggttccaaattacaaccttatagtgatggatgaagcgcatttcacagacccttctagtgtcgcagctagaggatacatctcaaccagggtggaaatgggagaggccgcagctatcttcatgactgcaacccctcctggaacaacagatcccttcccccagagcaacagcccaatagaagatatcgagagggaaattccagaaaggtcatggaacacagggtttgactggataacagactaccaagggaaaactgtgtggtttgttcccagcataaaagctggaaatgacattgcaaactgcttgagaaaatcgggaaagaaggtggtccaattgagtaggaaaacttttgacacagagtatccaaagacgaaactcacggactgggattttgtggttaccacagacatatctgaaatgggggccaactttagagctgggagagtgatagaccccaggagatgcctcaagccagttatcataactgacgggccagagagagttatcttagcgggtcccattccagtgactccagcaagcgctgctcagagaagagggcgaataggtaggaacccagcacaagaagatgaccaatatgtcttctctggagacccactaaggaatgatgaagatcatgcccactggactgaagcaaagatgcttcttgacaatatccacaccccggaagggatcattccaacactgtttggtccggaaagggaaaaaacccaagccattgatggagagttccgcctcagaggggaacaaaggaagacttttgtagaattaatgaggagaggagaccttccggtgtggctgagttacaaggtagcttctgctggtatctcttacaaagaccgggaatggtgcttcacgggggaaaggaataaccaaattctagaagaaaacatggaggtagaaatttggactagagagggagagaagaaaaaactcaggccaaaatggttagatgcacgtgtttacgctgaccccgtggctttgaaggatttcaaggagtttgccagtggaaggaagagcataaccctcgacatcctaacagaaattgccagtttgccaacgtacctttcctctagagctaagcttgcccttgacaacatagtcatgctccacacaacagaaagaggagggaaggcctaccaacacgccctgaacgaactcccagagtcactagaaacactcatgcttgtagctttactaggagctatgacagcaggcatctttttgttcttcatgcaaggaaaaggaatggggaaattgtcaatgggtttgatagccatcgcggtagctagtggcttgctctgggtagcagaaatccagccccagtggatagcagcctcaattatattggagttttttctcatggcgctgttgataccagaaccagaaaagcaaaggaccccacaagacaatcaattgatctacgtcatattgaccattctcaccattattggtctcgtagcagccaatgagatggggctaattgaaaaaacaaaaacggactttgggttttaccaggtaaaaacagaaactaccatccttgatgtggatttaagacccgcctcagcatggacgctctatgcagtagccaccactatcttgactcccatgctgagacacaccatagaaaacacgtctgcaaacctatctttagcggccattgccaaccaagcagccgtcttaatggggcttggaaaaggatggccgctccacagaatggaccttggtgtgccgctattggcaatgggatgctattcccaggtgaacccaacgactttaacagcatccttagtcatgcttttagttcattatgcaataataggtccaggattgcaggctaaagccacaagagaagctcagaaaaggacagctgctgggatcatgaagaaccccacggtagacgggataacagttatagatctagaaccaatatcctatgacccaaaatttgaaaagcagttagggcaggttatgctactagtcctgtgcgctgggcaactactcttgatgagaacaacatgggccttctgtgaagtcttgactttggccacaggaccaatcttgaccctgtgggagggcaacccgggaagattttggaacacgactatagccgtgtccacagccaacattttcaggggaagctacctggcgggagctggattggccttctcgctcataaagaatacacaaacccccaggaggggaaccgggaccacaggagagacactgggagaaaagtggaagagacaactgaactcactagataggaaggagtttgaagagtacaaaagaagtggaatactagaagtagacaggactgaagccaaatccgccctgaaagatggatctaaaatcaagtatgcagtgtccagagggaccagcaagattagatggattgttgaaagagggatggtaaagccaaaagggaaagttgtggaccttggttgtgggagaggagggtggtcgtactacatggccacactcaagaacgtgactgaggtgaaagggtacacaaaaggaggtccaggacatgaagaaccgattcccatggccacctatggctggaacttggtcaaactccattcaggggttgacgtgttctacaaacccactgagcaagtggacaccctgctctgtgacattggggagtcatcctctaatccgacgatagaggaaggaagaacgctaagagttttgaagatggtggagccatggctctcttcaaagcctgaattctgcatcaaagttcttaacccctacatgccaacagtcatagaagagctggagaaactgcagagaaaacatggtggaagtcttgtcagatgcccgttatccaggaattccactcatgagatgtattgggtgtcaggtgtgtcaggaaacattgtgagctctgtgaacacaacatcaaagatgttgttgaacagatttaccacaagatatagaaaacccacttatgagaaggacgcagaccttggagcaggaacgagaagcgtctccactgaaacagaaaaaccagacatggcaatcatcgggagaagactccagcgattgcaagaagagcacaaagaaacttggcactatgatcaagaaaatccatacagaacctgggcatatcatggaagctatgaggctccttcgacaggctcggcatcctccatggtgaacggggtagttaaattgctgacaaaaccctgggacgtgattccaatggtgacccagttggctatgacagacacaaccccttttgggcaacagagagtgttcaaagagaaggttgacaccaggacaccacagccaaaacccggcacacgaatgatcatgaccacgacagccaactggctatgggctctcctcggaaagaagaaaaatcccagactgtgcacaagggaagagttcatctcaaaagttaggtcgaatgcagccataggcgcagtcttccaggaagaacagggatggacatcagccagtgaagctgtgaatgatagccgattttgggaactggttgacaaagaaagggctctgcaccaggaagggaaatgtgaatcatgtgtctacaacatgatgggaaaacgtgagaaaaagttaggagagtttggcagagccaagggaagccgggcaatctggtacatgtggctgggagcgcggtttctggaatttgaagccctgggttttctgaatgaagatcattggtttggcagggaaaactcatggagtggagtggaaggggaaggtctgcataggttgggatacatcctggaggacatagataagaaggatggagatttgatatatgctgatgacacagcaggctgggacacaagaatcactgaagatgaccttctgaatgaagagctgatcacagaacagatggcccctcaccacaagatcctagccaaagccattttcaaactaacttatcaaaacaaagtggtaaaagtcctcagacccacaccgaagggagcagtgatggacatcatatctaggaaagatcaaagaggtagtggacaggttggaacatatggtttgaacacattcaccaacatggaagtacaacttatccgccaaatggaagctgaaggagtcatcacacgagatgacatgcataacccaaaagggttgaaagaaagagttgagaaatggctgaaagagtgtggtgtcgacaggttaaagaggatggcaatcagcggagacgattgtgtggtgaagcccctggatgagaggttcagcacttccctcctcttcttaaacgacatgggaaaggtgaggaaagacatcccgcaatgggaaccatccaaagggtggaaaaattggcaagaggttcccttttgctcccaccactttcacaagatctttatgaaggatggccgctcactggttgttccatgtaggaaccaggatgaactgatagggagagccagaatctcgcaaggagctggatggagtttaagagagacagcctgtctaggcaaagcttacgcccagatgtggtcgctcatgtattttcatagaagggacctgcgcttagcctccatggccatatgctcagcagtcccaacggagtggtttccaacaagcagaacaacatggtcaatccacgctcatcatcaatggatgaccactgaagatatgctcaaagtatggaacagagtgtggatagaagacaaccctaacatgactgataagactccagttcattcgtgggaagatataccttacctagggaaaagagaggatttgtggtgtggatccttgattggactctcttctagggccacctgggcgaagaacattcacacagccataacccaggtcaggaacctgatcggaaaagaagagtatgtagattacatgccagtcatgaaaagatacagcgctcctttcgagagtgaaggagttctgtaa

SEQ ID NO: 7790 - RNA, 9867 nt, synthetic construct
  misc_feature 1..9867: note = derived and/or modified CDS sequence (wt) from DENV-4__FJ024476__SS-prME
  source 1..9867: mol_type = other RNA
tcaacgataacattgctgtgcttgattcccaccgtaatggcgtttcacttgtcaacaagagatggtgaacccctcatgatagtggcaaaacatgaaagggggagacctctcttgtttaagacaacagaggggatcaacaaatgcactctcattgctatggacttgggtgaaatgtgtgaggacactgtcacgtataaatgccccctactggtcaataccgaacctgaagacattgattgctggtgcaacctcacggctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagagcatggaggatgcgtcacaaccatggcccagggaaaaccaaccttggattttgaactgactaagacaacagccaaggaagtggccctgttgagaacctattgtattgaagcctcaatatcaaacataactacggcaacaagatgtccaacgcaaggggagccttatctgaaagaggaacaggaccaacagtacatttgccggagagatgtggtagacagagggtggggcaatggctgtggcttatttggaaaaggaggagttgtgacatgtgcgaagttttcatgttcggggaagataacaggcaatttggtccagattgagaaccttgaatacacagtggttgtaacagtccataatggagacacccatgcagtaggaaatgacacatccaatcatggagtcacagccatgataactcctaggtcaccatcagtggaagtcaaattgccggactatggagaactaacactcgattgtgaacccaggtctggaattgactttaatgagatgattctgatgaaaatgaaaaagaaaacatggctcgtgcataagcaatggtttttggacctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgccggagctacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatttcatccactcctttggctgagaataccaacagtgtaaccaacatagaactagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggccgtgcaccaggtttttggaagtgtatatacaaccatgtttggaggagtctcatggatgattagaattctaattgggctcttagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgataacgtgcatacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggagggaggacatgacctcactgtagtggctggggatgtgaagggggtacttaccaaaggcaagagagcactcacacccccagtgagtgatctgaaatattcatggaagacatggggaaaagcaagaatcttcaccccagaagcaagaaacagcacatttttaatagacggaccagacacctctgaatgccccaatgaacgaagagcatggaactcccttgaggtggaagactatggatttggcatgttcacgaccaacatatggatgaaattccgggagggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccatgggcccatggcacttaggcaaattagagataggctttggagaatgccctggaacaacagtcacaatccaggaggattgtgaccatagaggcccatctttgaggaccaccactgcatctggaaaactagtcacgcaatggtgttgccgctcttgcacgatgcctcccttaaggttcttgggagaagatgggtgctggtatgggatggagattaggcccctgagtgaaagagaagagaacatggtcaaatcacaggtgacggccggacaaggcacatcagaaaccttttctatgggtctgttgtgcctgaccttgtttgtggaagaatgcttgaggagaagagtcactaggaaacacatgatattagttgtggtgatcactctttgtgccattatcctgggaggcctcacatggatggacttactacgagccctcatcatgttgggggacactatgtctggtagaataggaggacagatccacctagccattatggcagtgttcaagatgtcaccaggatacgtgctgggtgtgtttttaaggaaactcacttcaagagagacagcactaatggtaataggaatggccatgacaacggtgctttcaattccacatgacctcatggaactcattgatggaatatcactgggactaattttgctaaaaatagtaacacagtttgacaacactcaagtgggaaccttagctctttccttgactttcataagatcaacaatgccattggtcatggcttggaggaccatcatggctgtgttgtttgtggtcacactcattcctttgtgcaggacaagctgtctccaaaaacagtctcattgggtagaaataacagcactcatcctaggagcccaagctttgccagtgtacctaatgactcttatgaaaggagcctcaagaagatcttggcctcttaacgagggcataatggctgtgggtttggttagtctcttaggaagcgctctcttaaagaatgatgttcccttagctggcccaatggtagcaggaggtttacttctggcggcttacgtgatgagtggcagctcagcagatctgtcactagagaaggccgccaatgtgcagtgggatgaaatggcagacataacaggctcaagcccaatcatagaagtaaagcaggatgaagatggctctttctccatacgggacgtcgaggaaaccaatatgataaccctattggtgaaactggcactgataactgtgtcaggtctctaccccttggcaattccggtcacaatgaccttatggtacatgtggcaagtgaaaacacaaagatcaggagccctgtgggacgttccctcacccgctgccactcaaaaagccgcactgtctgaaggagtgtacaggatcatgcaaagagggttattcggaaaaactcaggttggagtagggatacacatggaaggtgtgtttcacacaatgtggcatgtaacaagaggatcagtgatctgccacgagactgggagactggagccatcttgggctgacgtcaggaatgacatgatatcatacggtgggggatggaggcttggagacaaatgggacaaagaagaagacgttcaggtcctcgctatagaaccaggaaaaaatcctaaacatgtccaaacgaaacctggtcttttcaagaccctaactggagaaattggagcagtaacattagatttcaaacccggaacgtctggttctcccatcatcaacaggaaaggaaaagtcatcggactttatggaaatggagtagttaccaaatcaggtgattacgtcagtgccataacgcaagccgaaagaattggagagccagattatgaagtggatgaggacatttttcgaaagaaaagattaactatcatggacttacaccccggagctggaaagacaaaaagaattctcccatcaatagtgagagaagccttaaaaaggaggctgcgaactttgattttggctcctacgagagtggtggcagccgagatggaagaggccctacgcggactgccaatccgttatcagaccccagctgtgaaatcagaacacacaggaagagagattgtagacctcatgtgtcacgcaaccttcacaacaagacttttgtcatcaaccagggttccaaattacaaccttatagtgatggatgaagcacatttcaccgatccttctagtgtcgcggctagaggatacatctcgaccagggtggaaatgggagaggcagcagccatcttcatgaccgcaacccctcccggagcgacagatccctttcctcagagcaacagcccaatagaagacatcgagagggaaattccggaaaggtcatggaatacagggttcgactggataacagactaccaagggaaaactgtgtggtttgttcccagcataaaagctggaaatgacatagcaaattgtttgagaaagtcgggaaagaaagttgtccagttgagtaggaaaacctttgacacagagtatccaaaaacgaaactcacggattgggactttgtggtcactacagacatatctgaaatgggggccaattttagagctgggagagtgatagaccctagaagatgcctcaagccagttatcctaacagatgggccagagagagttattttagcaggtcctattccagtgactccagcaagcgctgcgcagagaagagggcgaataggaaggaacccagcacaagaagacgaccaatacgttttctccggagacccactaaaaaatgatgaagatcatgcccactggacagaagcaaagatgttgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatatcttataaagatcgggaatggtgcttcacaggggaaagaaataaccaaattttagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacactcatgcttgtagctttactaggtgctatgacagcaggtatcttcctgtttttcatgcaagggaaaggaatagggaaattgtcaatgggtttgataaccattgcggtggccagtggcttgctctgggtagcagaaattcaaccacagtggatagcggcctcaatcatactggagttttttctcatggtactgttgataccagaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagctaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattcccaagtgaatccaacaaccttgacagcatccttagtcatgcttttagtccactatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaattttgaccttgtgggagggcaacccgggaaggttttggaacacgaccatagccgtgtccaccgccaacattttcaggggaagctacttggcgggagctggactggctttttcactcataaagaatgcacaaacccctagaaggggaactgggaccacaggagagacactgggagaaaagtggaagagacagctaaactcattagacagaaaagagtttgaagagtataaaagaagtggaatactagaagtggacaggactgaagccaagtctgccctgaaagatgggtctaaaatcaagcatgcagtatctagagggtctagcaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagtcttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctacgaagctccttcgacaggctctgcatcctccatggtgaacggggtagtgaaactgctaacaaaaccctgggatgtgattccaatggtgactcagttagccatgacagacacaaccccttttgggcaacaaagagtgttcaaagagaaggtggataccagaacaccacaaccaaaacccggaacacgaatggttatgaccacgacagccaattggctgtgggccctccttggaaagaagaaaaatcccagactgtgcacaagggaagagttcatctcaaaagtcagatcaaacgcagccataggcgcagtcttccaggaagaacaaggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggtagagccaagggaagccgagcaatctggtacatgtggctgggagcgcggtttttggaatttgaagccctgggttttttgaatgaagaccactggtttggcagagaaaattcatggagtggagtggaaggggaaggcctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtagtgaaagtcctcagacccacaccgagaggagcggtgatggatatcatttccaggaaagaccaaagaggtagtggacaagttggaacatatggtctgaacacattcaccaacatggaagttcaactcatccgccaaatggaagctgaaggagtcatcacacaagatgacatgcagaacccaaaagggttgagagaaagagttgagaaatggttgaaagagtgtggcgtcgacaggttaaaaaggatggcaatcagtggagacgattgcgtggtgaagcccctagatgagaggtttggcacttccctcctcttcttgaatgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcctaagagaaacagcctgtctgggcaaagcttacgcccagatgtggtcgcttatgtactttcacagaagggatctgcgcttggcctccatggccatatgctcagcagttccaacagaatggtttccaacaagcagaacaacatggtcaatccacgctcatcaccagtggatgaccactgaagatatgctcaaagtgtggaacagagtgtggatagaagacaatcctaatatgactgacaagactccagtccattcgtgggaagatataccttacctaggaaaaagagaggatttgtggtgtggatccctgattggactttcttccagagccacctgggcgaagaacattcacacggccataacccaggtcaggaacctgatcgggaaagaggaatacgtggattacatgccagtaatgaaaagatacagtgctccttcagagagtgaaggagttctgtaa

SEQ ID NO: 7791 - RNA, 9867 nt, synthetic construct
  misc_feature 1..9867: note = derived and/or modified CDS sequence (wt) from DENV-4__GQ868579__SS-prME
  source 1..9867: mol_type = other RNA
tcaacgataacattgttgtgcttgatccccaccataatggcgtttcacttgtcgacaagagatggcgaacccctcatgatagtggcaaaacatgaaagggggagacctctcttgttcaagacaacagaggggatcaacaaatgcactctcattgccatggatttgggtgaaatgtgtgaggacactgtcacgtacaaatgccccctactgatcaataccgaacctgaagacattgattgctggtgcaacctcacgtctacctgggtcatgtatgggacatgcacccagagcggtgaacggagacgagagaagcgctcagtagctttaacaccacattcaggaatgggattggaaacaagagctgagacatggatgtcatcggaaggggcttggaagcacgctcagagagtagagagctggatactcagaaacccaggatttgcgctcttggcaggatttatggcttatatgattgggcaaacaggaatccagcgaactgtcttctttatcctaatgatgctggtcgccccatcctacggaatgcgatgcgtaggagtaggaaacagagactttgtggaaggagtctcaggtggagcatgggtcgacctggtgctagaacatggagggtgcgtcacaaccatggcccagggaaaaccaaccttggattttgaactgactaagacaacagccaaggaagtagctctgttaagaacctattgcattgaagccttaatatcaaacataactacggcaacaagatgtccaacgcaaggagagccttacctgaaagaggaacaggaccaacagtacatctgccggagagatgtggtagacagaggatggggcaatggctgtggcttgttcggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtgaccaacatagaattagaacccccttttggggacagctacatagtgataggtgttggaaatagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcatcaggtttttggaagtgtgtatacaaccatgtttggaggagtctcatggatgattagaatcctaattgggttcttagttttgtggattggcacgaactcaaggaacacttcaatggccatgacgtgcatagctgttggaggaatcactctgtttttgggcttcacagttcgagcggacatgggttgtgtggtgtcatggagtgggagagaattgaagtgtggaagcggaatttttgtggttgacaacgtgcacacttggacagaacagtacaaattccagccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgacctgaaatattcatggaagacatggggaaaagcaaaaatcttcacccctgaagcaagaaacagcacatttttgatagacggaccagacacctctgaatgccccaatgaacgaagagcatggaattctcttgaggtggaagactatggatttggcatgttcactaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaagaggattgtgaccatagaggcccatctttgaggaccaccactgcatctggaaaactagtcacgcaatggtgttgccgctcctgcacgatgccccccttaaggttcttgggagaagatgggtgctggtatgggatggagattaggcccctgagtgaaaaagaagagaacatggttaaatcacaggtgacggccggacagagcacatcggaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgatcttatggaactcattgatggaatatcactaggactaattttgctaaaaatagtaacacagtttgacaacacccaagtgggaaccttagctctttccttgactttcataagatcaacaatgtcattggtcatggcttggaggactattatggctgtgttgtttgtggtcacactcattcctttgtgcaggacaagctgtcttcaaaaacagtctcattgggtagaaataacagcactcatcttaggagcccaagctctgccagtgtacctgatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagccgatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctatcccttggcaattccagtcacaatgaccttgtggtacatgtggcaagtgaaaacacaaagatcaggagctctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagactggagccatcttgggctgacgtcaggaatgacatgatatcatacggtgggggatggaggcttggagacaaatgggacagagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattattaacaagaaaggaaaagtcatcggactctatggaaatggagtggtcaccaaatcaggtgattacgtcagtgccataacgcaagccgaaagaattggagagccagattatgaagtggatgaggacatttttcgaaagaaaagactaactataatggacttacaccccggtgctggaaagacaaaaagaattcttccatcaatagtgagagaagccttaaaaaggaggctgcgaactttgattttggcccccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagctatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaattttagagctgggagagtgatagaccctagaagatgcctcaagccagttatcctaacagatgggccagagagagtcattttagcaggtcccattccagtgactccagcaagcgctgctcagagaagagggcgaataggaaggaacccagcacaagaagatgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccatcgatggagagtttcgcctcagaggggaacaaaggaagacttttgtggaattaatgaggagaggagaccttccggtgtggctgagctataaggtagcttctgctggcatttcttacaaagatcgggaatggtgcttcactggggaaagaaacaaccaaattttagaagaaaacatggaggttgaaatttggactagagagggagaaaagaaaaaactgaggccaagatggttagatgcacgtgtatacgctgaccctatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacacttatgcttgtagccttactaggtgctatgacagcaggtaccttcctgtttttcatgcaagggaaaggaatagggaaattgtcaatgggtttgataaccattgcgatggctagtggcttgctctggatagcagaaattcaaccccagtggatagcagcctcaatcatactggagttttttctcatggtactgttgataccagaaccagaaaaacaaaggaccccacaagacaatcaattgatctacgtcatattgaccattctcgccattattggtctaatagcagccaacgaaatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagacctagaaccaatatcctatgacccaaaatttgaaaagcaattagggcaggtcatgctactagtcttatgtgctggacaactactcttaatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaagcccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtttctagagggtccagtaagatcagatggatcgttgagagagggatggtaaagccaaaagggaaagttgtagatcttggctgtgggagaggaggatggtcttattatatggcgacactcaagaacgtgactgaagtgaaagggtatacaaaaggaggtccagggcatgaagaaccgattcccatggctacttatggctggaatttggtcaaactccattcaggggttgacgtgttctacaaacccacagagcaggtggacaccctgctctgtgacattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggacaccagaacaccgcaaccaaaaccaggcacacgaatggttatgaccacgacagccaattggctatgggccctccttggaaagaagaaaagtcccagactgtgcacaagggaagagttcatctcgaaagttagatcaaacgcagccataggcgcagtctttcaggaggaacagggatggacatcagccagtgaagctgtgaatgacagccggttttgggaactggttgacaaagaaagggcccttcaccaagaagggaaatgtgaatcgtgtgtctataacatgatgggaaaacgtgaaaaaaaattaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaacttatccgccaaatggaagctgaaggagtcatcacacaagatgacatgcagaacccaaaagggttgaaagaaagagttgagaactggctgagagagtgtggtgtcgacaggttaaagaggatggcaatcagtggagacgattgtgtagtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcattagttgttccatgtagaaaccaggatgaactgatagggagggccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcaccaccaatggatgaccactgaagacatgctcaaggtgtggaacagagtgtggatagaagacaaccccaacatgattgacaagactccagtccattcgtgggaagatataccttacctaggaaaaagagaggatttgtggtgtggatccctgattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 7792 - RNA, 9867 nt, synthetic construct
  misc_feature 1..9867: note = derived and/or modified CDS sequence (wt) from DENV-4__GQ868580__SS-prME
  source 1..9867: mol_type = other RNA
tcaacgataacattgttgtgcttgattcccaccataatggcgtttcacttgtcgacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactgatcaataccgaacctgaagacattgattgctggtgcaacctcacgtctacctgggtcatgtatgggacatgcacccagagcggtgaacggagacgagagaagcgctcagtagctttaacaccacattcaggaatgggattggaaacaagagctgagacatggatgtcatcggaaggggcttggaagcacgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtagctctgttaagaacctattgcattgaagccttaatatcaaacataactacggcaacaagatgtccaacgcaaggagagccttacctgaaagaggaacaggaccaacagtacatctgccggagagatgtggtagacagaggatggggcaatggctgtggcttgttcggaaaaggaggagttgtgacatgtgcgaagttttcatgttcggggaagataacaggcaatctggtccaaattgagaacctagaatacacagtggttgtaacagtccacaatggagacacccatgcagtaggaaatgacacatccaaccatggagttacagctacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcattatctcatccacccctttggctgagaataccaacagtgtaaccaacatagaattagaacccccttttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggctccgttggtggactgttcacatcattgggaaaggctgtgcaccaggtttttggaagtgtgtatacaaccatgtttggaggagtctcatggatgattagaatcctaattgggttcttagttttgtggattggcacgaactcaaggaacacttcaatggccatgacgtgcatagctgttggaggaatcactctgtttttgggcttcacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaacgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgacctgaaatattcatggaagacatggggaaaagcaaaaatcttcacccctgaagcaagaaacagcacatttttgatagacggaccagacacctctgaatgccccaatgaacgaagagcatggaattctcttgaggtggaagactatggatttggcatgttcactaccaacatatggatgaaattccgagaaggaagttcagaagtgtgtgaccacaggttaatgtcggctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaagaggattgtgaccatagaggcccatctttgaggaccaccactgcatctggaaaactagtcacgcaatggtgttgccgctcctgcacgatgccccccttaaggttcttgggagaagatgggtgctggtatgggatggagattaggcccctgaatgaaaaagaagagaacatggttaaatcacaggtgacggccggacagagcacatcggaaactttttctatgggtctgttgtgcctgaccttgtttgtggaagaatgcttgaggagaagagtcactaggaaacacatgatattagctgtggtaatcactctttgtgctatcatcctgggaggtctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacattttcaattccacatgatcttatggaactcattgatggaatatcactaggactaattttgctaaaaatagtaacacagtttgacaacacccaagtgggaaccttagctctttccttgactttcataagatcaacaatgtcattggtcatggcttggaggactatcatggctgtgttgtttgtggtcacactcattcctttgtgcaggacaagctgtcttcaaaaacagtctcattgggtagaaataacagcactcatcttaggagcccaagctctgccagtgtacctgatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagccgatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcaattccagtcacaatgaccttgtggtacatgtggcaagtgaaaacacaaagatcaggagctctgtgggacgtcccctcacccgctgccactcaaaaagccgcactgtctgaaggagtgtacaggatcatgcaaagagggttactcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacagagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggacatttttcgaaagaaaagactaactataatggacttacaccccggagctggaaagacaaaaagaattcttccatcaatagtgagggaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagctatcttcatgaccgcaacccctcccggagcgacagatccctttccccagagcaacagcccaatagaagacatcgagagagagattccagaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagatgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcactggggaaagaaacaaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgcttcacacaacagaaagaggagggagggcctatcaacacgccctgaacgaacttccggagtcactggaaacacttatgcttgtagccttactaggtgctatgacagcaggtatcttcctgtttttcatgcaagggaaaggaatagggaaattgtcaatgggtttgataaccattgcgatggctagtggcttgctctggatagcagaaattcaaccccagtggatagcggcctcaatcatactggagttttttctcatggtactgttaataccagaaccagaaaaacaaaggaccccacaagacaatcaattgatctacgtcatattgaccattctcaccattattggtctaatagcagccaacgaaatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagacctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtacaaaagaagtggaatactagaagtggacaggactgaagccaagtctgcccttaaagatgggtctaaaatcaagcatgcagtttctagagggtccagtaagatcagatggatcgttgagagagggatggtaaagccaaaagggaaagttgtagatcttggctgtgggagaggaggatggtcttattatatggcgacactcaagaacgtgactgaagtgaaagggtatacaaaaggaggtccagggcatgaagaaccgattcccatggctacttatggctggaatttggtcaaactccattcaggggttgacgtgttctacaaacccacagagcaggtggacaccctgctctgtgacattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaactccttttgggcaacaaagagtgttcaaagagaaggtggataccagaacaccgcaaccaaaaccaggcacacgaatggttatgaccacgacagctaattggctatgggccctccttggaaagaagaaaagtcccagactgtgcacaagggaagagttcatctcaaaagttaggtcaaacgcagccataggcgcagtctttcaggaggaacagggatggacatcagccagtgaagctgtgagtgacagccggttttgggaactggttgacaaagaaagggcccttcaccaagaagggaaatgtgaatcgtgtgtctataacatgatgggaaaacgtgagaaaaagttaggagagtttggtagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatagtttgaacacattcaccaacatggaagttcaactcatccgccaaatggaagctgaaggagtcatcacacaagatgacatgcagaacccaaaagggttgaaagaaagagttgagaactggctgagagagtgtggtgtcgacaggttaaagaggatggcaatcagtggagacgattgtgtagtgaagcccttggatgagaggtttggcacttccctcctcttcttgaacgacatgggaaaggtgaggaaagacattccgcagtgggaaccatctaagggatggaaaaactggcaagaggttcctttttgctcccaccacttccacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaacatgattgacaagactccagtccattcgtgggaagatataccttacctaggaaaaagagaggatttgtggtgtggatccctgattggactttcttctagagccacctgggcgaagaacattcacacggccataactcaggtcaggaacctgatcggaaaagaggaatacgtggattacatgccagtcatgaaaagatacagtgctccttcagagagtgaaggagttctgtaa

SEQ ID NO: 7793 - RNA, 9867 nt, synthetic construct
  misc_feature 1..9867: note = derived and/or modified CDS sequence (wt) from DENV-4__GQ868583__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaaaacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagaaaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccctaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggggttacagccacgataactcccaggtcaccatcggtagaagtcaaactgccggactatggagaattaacactcgattgtgaacccaggtctggaattgacttcaatgagatgatcctaatgaaaatgaaaaagaaaacatggctcgtgcataagcaatggtttttggatctgcctcttccatggacaacaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagttcgtatggagaaattgagaatcaagggaatgtcatacacgatgtgctcaggaaagttttcaattgacaaagagatggcagaaacacagcatgggacaacagtggtgaaagtcaagtatgaaggtgctggagctccgtgtaaagtccccatagagataagagatgtgaacaaggaaaaagtggttgggcgcgtcatctcagccacccctttggctgagaataccaacagtgtaaccaacatagaattagaacccccctttggggacagctacataatgataggtgttggaaacagcgcactaacactccattggttcaggaaagggagttccattggcaagatgtttgagtccacatatagaggtgcaaaacgcatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaagggcaagagagcactcgcacccccagcgagtgatctgaaatattcatggaagacatggggaaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacaggttaatgtcagccgcaattaaagaccagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggtccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcctgggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgttaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaatgagggcataatggctgtgggtttggttagtctcctaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccagtcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgatgtcaggaatgacatgatatcatacggtgggggatggaggcttggagacaaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaagatatttttcgaaagaaaagattaactataatggacttacaccctggagctggaaagacaaaaagaattcttccatcaatagtgagagaagccttaaaaaggaggctgcgaactttgattttggctcccacgagagtggtggcggccgagatggaagaggcccttcgtggactgccaatccgttaccagaccccagctgtgaaatcagaacacacaggaagagagattgtagacctcatgtgccatgcaaccttcacaacaagacttttgtcatcaaccagggttccaaattacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttaagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgcaggatttcaaggagtttgccagtggaaggaagagtataactctcgacatcctaacagagatcgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaattatactggagttttttctcatggtgctgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagttttgactttggccacaggaccaatcttgaccttgtgggagggcaacccgggaaggttttggaacacgaccatagccgtatccaccgccaacatttttaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccactcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctatatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaggaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaatgcagccataggcgcagtctttcaggaggaacagggatggacatcagccagtgaagctgtgagtgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaagatggagacctaatgtatgctgatgacacagcaggctgggacacaagaatcactgaggatgacctccaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaacgacatgggaaaggtgaggaaagatattccgcagtgggaaccatctaagggatggaaaaactggcaggaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagtcccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatctatggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7794 - RNA, 9867 nt, synthetic construct
  misc_feature 1..9867: note = derived and/or modified CDS sequence (wt) from DENV-4__GQ868584__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaaaacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagaaaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccctaatatcaaacataactacggcaacaagatgtccaacgcaaggagagccttatctgaaagaggaacaggaccgacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggggttacagccacgataactcccaggtcaccatcggtagaagtcaaactgccggactatggagaattaacactcgattgtgaacccaggtctggaattgacttcaatgagatgatcctaatgaaaatgaaaaagaaaacatggctcgtgcataagcaatggtttttggatctgcctcttccatggacaacaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagttcgtatggagaaattgagaatcaagggaatgtcatacacgatgtgctcaggaaagttttcaattgacaaagagatggcagaaacacagcatgggacaacagtggtgaaagtcaagtatgaaggtgctggagctccgtgtaaagtccccatagagataagagatgtgaacaaggaaaaagtggttgggcgcgtcatctcagccacccctttggctgagaataccaacagtgtaaccaacatagaattagaacccccctttggggacagctacataatgataggtgttggaaacagcgcactaacactccattggttcaggaaagggagttccattggcaagatgtttgagtccacatatagaggtgcaaaacgcatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaagggcaagagagcactcgcacccccagcgagtgatctgaaatattcatggaagacatggggaaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacaggttaatgtcagccgcaattaaagaccagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggtccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcctgggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgttaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaatgagggcataatggctgtgggtttggttagtctcctaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccagtcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgatgtcaggaatgacatgatatcatacggtgggggatggaggcttggagacaaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaagatatttttcgaaagaaaagattaactataatggacttacaccctggagctggaaagacaaaaagaattcttccatcaatagtgagagaagccttaaaaaggaggctgcgaactttgattttggctcccacgagagtggtggcggccgagatggaagaggcccttcgtggactgccaatccgttaccagaccccagctgtgaaatcagaacacacaggaagagagattgtagacctcatgtgccatgcaaccttcacaacaagacttttgtcatcaaccagggttccaaattacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttaagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaattatactggagttttttctcatggtgctgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagttttgactttggccacaggaccaatcttgaccttgtgggagggcaacccgggaaggttttggaacacgaccatagccgtatccaccgccaacatttttaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccactcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctatatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaggaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaatgcagccataggcgcagtctttcaggaggaacagggatggacatcagccagtgaagctgtgagtgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaagatggagacctaatgtatgctgatgacacagcaggctgggacacaagaatcactgaggatgacctccaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaacgacatgggaaaggtgaggaaagatattccgcagtgggaaccatctaagggatggaaaaactggcaggaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagtcccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatctatggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7795 - RNA, 9867 nt, synthetic construct
  misc_feature 1..9867: note = derived and/or modified CDS sequence (wt) from DENV-4__GQ868585__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggttgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatgaaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttgggcaaactagagatagactttggagaatgccccggaacaacagttacaattcaggagaattgtgatcatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactgattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcacttatcctaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtccgaaggagtgtacaggatcatgcaaagagggttattcgggaaaactcaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttcccccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctatcccagtgactccagcaagcgctgcccagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtggcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttatagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctaggagcgcggtttctggaatttgaagccctgggttttttgaacgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7796 - RNA, 9867 nt, synthetic construct
  misc_feature 1..9867: note = derived and/or modified CDS sequence (wt) from DENV-4__JQ922560__SS-prME
  source 1..9867: mol_type = other RNA
tcaacaataacattgttgtgcttgattcccaccgtaatggcgtttcacttgtcaacgagagatggcgaaccccttatgatagtggcgaaacacgaaagggggagacgtctcttgttcaagacaacagaaggaatcaacaagtgcactctcattgccatggacctgggtgaaatgtgcgaggacaccgttacgtataaatgccccttgctggtcaacaccgaacctgaagacattgattgctggtgtaatctcacgtctgcctgggtcatgtatgggacatgcacccaaagtggggaacggagacgagagaagcgctcagtagctctaacaccacattcaggaatgggattggaaacaagggctgaaacatggatgtcatcggaaggagcttggaaacacgcccagagggtagagagttggatactcagaaacccaggattcgcgctcttggcaggatttatggcctatatgattgggcaaacaggaatccagcggacagtcttctttattttaatgatgctggtcgctccatcctacggaatgcgatgtgtaggagtggggaacagagacttcgtggaaggagtctcaggtggagcatgggtcgatctggtgctagaacatggaggatgtgttacaaccatggcccagggaaaaccaaccttggattttgaactgatcaagacaacggctaaggaagtggctctgttaagaacctattgcatcgaagcctccatatcaaacataaccacggcaacaagatgtccaacgcaaggagagccttaccttaaagaggaacaagatcaacagtacatttgccggagagacgtggtagacagagggtggggcaatggctgtggcctgtttgggaaaggaggagttgtgacatgtgcgaagttttcatgcacggggaagataacaggcaacttaatccaaattgagaacctagaatacacagtggttgtaacagtccacaatggagacacccatgcagtaggaaatgacacatccaaccacggagtgacagctacgataacccccaggtcaccatcggtagaagttgaattgccggactatggagagttgacactcgattgtgagcccaggtccggaattgactttaatgagatgattctgatgaaaatgaataagaaaacgtggctcgtgcacaagcaatggtttttggatctacctctaccatgggcagcaggagcagacacgtcagaagttcattggaatcacaaagaaagaatggtgacgtttaaggtccctcatgccaagagacaggatgtgacagtgctaggatctcaggaaggagccatgcattcagccctcaccggagccacggaagtatattccggtgatggaaacctcatgtttgcaggacatttgaaatgcaaagttcgcatggagaaattgaggatcaagggaatgtcatacacgatgtgctcaggaaagttttcaattgataaagaaatggcagaaacacagcatgggacaacagtggtaaaagtcaagtatgagggtgctggagctccatgcaaagttcccatagagataagagatgtgaacaaggaaaaagtggttgggcgtgtcatctcatctaccccttttgctgagaataccaacagtgtgaccaatatagaactggaacccccctttggggatagctatatagtaataggtgtaggagacagcgcactgacacttcattggttcacgaaaggaagttccatcggcaagatgtttgagtccacatacagaggcgcaaagcgtatggccattctaggtgaaacagcttgggattttggctctgttggtggactgctcacatcattgggaaaggctgtacaccaagtttttggtagtgtgtatacaactatgttcggaggagtctcatggatggttagaatcctaattgggttcttagtattgtggattggcacgaattcaagaaacacctcaatggcaatgtcatgcatagctgttggagggattactttgtttctgggtttcacagtccatgcagacatgggttgtgcggtgtcatggagtgggaaagaattgaagtgtggaagcggaatctttataattgacaacgtgcacacttggacagaacagtacaagttccaaccagagtcaccagcgagactagcgtccgcaatactgaatgcccacaaagatggggtctgtggaattagatcaaccacgaggttggaaaatgtcatgtggaagcaaataaccaatgagttaaactatgtgctctgggaaggaggacatgacctcactgtagtggccggggacgtgaaaggggtgttatccaaaggcaagagagcactagcacctccagtgaatgatctgaaatattcatggaagacatggggaaaagcaaagatcttcactccagagacaagaaacagcacattcttaatagacggaccagacacctccgaatgtcccaatgaacgaagagcatggaattttcttgaggtagaagactacggatttggcatgttcacgaccaacatatggatgaaatttcgagaaggaagttcagaaatgtgtgaccacaggttgatgtcggcggcaatcaaagaccagaaagctgtacatgctgatatgggctactggatagagagctcaaaaaaccagacctggcagatagagaaggcatccctcattgaagtgaaaacatgtctatggcccaagacccacacattgtggagcaatggagtgctggaaagccagatgctcatcccgaaagcatatgcaggccctttttcacagcacaattaccgccagggctacgccacgcagactgtgggcccatggcacttgggaaaactggagatagactttggagaatgccccggaacaacagtcaccattcaagaggattgtgaccatagaggcccgtctttgaggaccaccactgcatctggaaaactggtcacgcagtggtgctgccgctcctgcacgatgcctcccttaaggtttttaggagaggatggatgttggtatgggatggaaattaggcccttgagtgaaaaagaagagaatatggttaaatcacaggtgtcggccggacagggtacatcagaaactttttccatggggctgttgtgcctgactctatttgtggaagaatgcttgaggagaagagtcaccaggaaacacatgatattggttgtggtgaccaccctttgtgccatcatcttaggaggtctcacatggatggacttactgcgagcccttatcatgctagggaacaccatgtctagtagaatgggaggacagattcacctagccatcatggcagtgtttaagatgtcaccaggatacgtgctgggtatatttttgaggaaactcacttcaagagagacagcactaatggtgataggaatggccatgacaacggtgctttcaattccacatgaccttatggaatttgttgatggaatatcactagggttgatcttgttaaagatggtaacacattttgacaacactcaagtaggaaccttagccctttccttgactttcataaaatcaacaatgccattggtcatggcttggaggaccataatggcggtgttgtttgtggtcacactcattcctctatgcaggacaagctgtcttcagaagcagtcccattgggtggaaataacagcactcatcctgggagcccaggctctgccagtgtacctgatgactctcatgaaaggagcctcaaagagatcttggccccttaacgaaggtataatggctgtgggcttggtcagtctcttgggaagcgcccttctaaagaatgatgtccctctagctggcccaatggtggcaggaggcttacttctggcagcctacgtgatgagcggtagctcagcggacctgtcactagagaaggctgccactgtgcagtgggatgagatggcagacataacaggctcaagcccaatcatagaagtgaagcaggatgaagacggctctttctccatacgggacgtcgaggaaaccaacatgataaccctcctggtgaaactggcactgataacagtgtcaggtctctaccccttggcaattccagtcacaatgaccctatggtacatgtggcaagtgaaaacacaaagatcaggagccctgtgggacgttccctcacctgctgccgctcagaaagccacactgactgaaggagtgtacaggatcatgcaaagagggttatttgggaaaactcaggttggagtggggatacacatggaaggtgtgtttcacacaatgtggcatgtaacaagaggatcagtgatctgccatgagagtgggagactggagccatcttgggctgacgtcaggaatgacatgatatcatacggtgggggatggaggctcggagacaaatgggataaagaagaagacgttcaagttctagctgtagaaccagggaaaaatccgaaacatgtccaaacgaaacccggccttttcaaaaccctaactggagaaattggagcggtaacattggacttcaaacccggaacatccggttctcccatcattaataggaaaggaaaagtcattggactttatggaaatggggtagtcaccaaatcaggtgattacgtcagtgccataacacaagctgaaagaattggcgaaccagattatgaagtggatgaggacatcttccgaaagaaaagattgaccataatggacttacaccccggagccggaaagacaaaaagaattcttccatcaatcgttagagaagctttaaaaaggaggctacgaaccctgatcctggcacccacgagagtggtggcggccgaaatggaagaagccctacgcggactgccaatccgttaccagaccccagctgtgaaatcagaacacacaggaagggagatcgtagacctcatgtgccatgcaaccttcacaacaagacttttatcatcaaccagagttccaaattacaaccttatagtgatggatgaagcgcatttcacagacccttctagtgtcgcagctagaggatacatctcaaccagggtggaaatgggagaggccgcagctatcttcatgactgcaacccctcctggaacaacagatcccttcccccagagcaatagcccaatagaagatatcgagagagaaattccagaaaggtcatggaacacagggtttgactggataacagactatcaagggaaaactgtgtggtttgttcccagcataaaagctggaaatgacattgcaaactgcttgagaaaatcgggaaagaaggtggtccaattgagtaggaaaacctttgacacagaatatccaaaaacgaaactcacggactgggattttgtggttaccacagacatatctgaaatgggggccaactttagagctgggagagtgatagaccccaggagatgcctcaagccagttatcataactgacgggccagagagagttatcttagcgggtcctattccagtgactccagcaagcgctgctcagagaagagggcgaataggtaggaacccagcacaagaagatgaccaatatgtcttctctggagacccactaaggaatgatgaagatcatgcccactggactgaagcaaagatgcttcttgacaatatctacaccccagaagggatcattccaacactgtttggtccggaaagggaaaaaacccaagccattgatggagagttccgcctcagaggggaacaaaggaagacttttgtagaattaatgaggagaggagatcttccggtgtggctgagttacaaggtagcttctgctggtatctcttacaaagaccgggaatggtgcttcacgggggaaaggaataaccaaattctagaagaaaacatggaggtagaaatttggactagagagggagagaagaaaaaactcaggccaaaatggttagatgcacgtgtttacgctgaccccgtggctttgaaggatttcaaggagtttgccagtggaaggaagagcataacccttgacatcctaacagaaattgccagtttgccaacgtacctttcctctagagctaagcttgcccttgacaacatagtcatgctccacacaacagaaagaggagggaaggcctaccaacacgccctgaacgaactcccagagtcactagaaacactcatgcttatagctttactaggagctatgacagcaggcatcttcttgttcttcatgcaaggaaaaggaatggggaaattgtcaatgggtttgatagccatcgcggtagctagtggcttgctctgggtagcagaaatccagccccagtggatagcagcctcaatcatattggagttttttctcatggcgctgttgataccagaaccagaaaaacaaaggaccccacaagacaatcaattgatctacgtcatattgaccattctcaccattattggtctcgtggcagccaatgagatggggctaattgaaaaaacaaaaacggactttgggttttaccaggaaaaaacagaaaccaccatccttgatgtggatttgagacccgcctcagcatggacgctctatgcagtagccactactatcttgactcccatgctgagacacaccatagaaaacacgtctgcaaacctatctttagcggccattgccaaccaagcagccgttttaatggggcttggaaaaggatggccgctccacagaatggaccttggtgtgccgctattagcaatgggatgctattcccaagtgaacccaacgactttaacagcatccttagtcatgcttttagttcattatgcaataataggtccaggattgcaggctaaagccacaagagaagctcagaaaaggacagctgctgggatcatgaagaaccccacggtggacgggataacagttatagatctagaaccaatatcctatgacccaaaatttgaaaagcagttagggcaggttatgttactagtcctgtgcgctgggcaactactcttgatgagaacaacatgggccttctgtgaagtcttgactttggccacaggaccaatcttgaccctgtgggagggcaacccgggaaggttttggaacacgactatagccgtgtccacagctaacattttcaggggaagctacctggcgggagctggattggccttctcgctcataaagaatacacaaacccccaggaggggaaccgggaccacaggagagacactgggagaaaagtggaagagacaactgaactcactagataggaaggagtttgaagagtacaaaagaagtggaatactagaagtagacaggactgaagccaaatctgccctgaaagatggatctaaaatcaagtatgcagtgtccagagggaccagcaagattagatggattgttgaaagagggatggtaaagccaaaagggaaagttgtggacctcggctgtgggagaggaggatggtcgtactacatggccacactcaagaacgtgactgaggtgaaagggtacacaaaagggggtccaggacatgaagaaccgattcctatggccacctatggctggaacttggtcaaactccattcaggggttgacgtgttctacaaacctactgagcaagtggacaccctgctctgtgatattggggagtcatcctctaatccgacgatagaggaaggaagaacgctaagagttttgaagatggtggagccatggctctcttcaaagcctgaattctgcatcaaagttcttaacccctacatgccaacagtcatagaagagctggagaaactgcagagaaaacatggtggaagtcttgtcagatgcccgttatccaggaattccactcatgagatgtattgggtgtcaggtgtgtcacgaaacattgtgagctctgtgaacacaacatcaaagatgttgttgaacagatttaccacaagatatagaaaacccacttatgagaaggacgcagaccttggagcaggaacgagaagtgtctccactgaaacagaaaaaccagacatggcaatcattgggagaagactccagcgattgcaagaagagcacaaagaaacttggcactatgatcaagaaaatccatacagaacctgggcatatcatggaagctatgaggctccttcgacaggctcggcatcctccatggtgaacggggtagttaaactgctgacaaaaccttgggacgtggttccaatggtgacccagttggctatgacagacacaaccccttttgggcaacagagagtgttcaaagagaaggttgacaccaggacgccacagccaaaacccggcacacgaatgatcatgaccacgacagccaactggctgtgggctctcctcgggaagaagaaaaatcccagactgtgcacaagggaggagttcatctcaaaagtcaggtcgaatgcagccataggcgcagtctcccaggaagaacagggatggacatcagccagtgaagctgtgaatgacagccgattttgggaactggttgacaaagaaagggctctgcaccaggaagggaaatgtgaatcatgtgtctacaacatgatgggaaaacgtgagaaaaagttaggagagtttggcagagccaagggaagccgagcaatctggtacatgtggctgggagcgcggtttctggaatttgaagccctgggttttctgaatgaagatcactggtttggtagggaaaactcatggagtggagtggaaggggaaggtctgcataggttgggatacatcctggaggacatagataagaaagatggagatttgatatatgctgatgacacagcaggctgggacacaagaatcactgaagatgaccttctgaatgaagagctgatcacagaacagatggcccctcaccacaagatcctagccaaagccattttcaaactaacttatcaaaacaaagtggtaaaagtcctcagacccacaccgaagggagcagtgatggacatcatatctaggaaagatcaaagaggtagtggacaggttggaacatatggtttgaacacattcaccaacatggaagtacaacttatccgccaaatggaagctgaaggagtcatcacacgagatgacatgcataacccaaaagggttgaaagaaagagttgagaaatggctgaaagagtgtggtgtcgacaggttaaagaggatggcaatcagcggagacgattgtgtggtgaagcctctggatgagaggttcagcacttccctcctcttcttaaacgacatgggaaaggtgaggaaagacatcccgcaatgggaaccatccaaagggtggaaaaactggcaagaggttcctttttgctcccaccactttcacaagatctttatgaaggatggccgctcactggttgttccatgtaggaaccaggatgaactgatagggagagccagaatctcacaaggagctggatggagtttaagagaaacagcctgtctgggcaaagcttacgcccagatgtggtcgctcatgtattttcatagaagggacctgcgcttagcctccatggccatatgctcagcagtcccaacggagtggtttccaacaagcagaacaacatggtcaatccacgctcatcatcaatggatgaccactgaagatatgctcaaagtatggaacagagtgtggatagaagacaaccctaacatgactgataagactccagttcattcgtgggaagacataccttacctagggaaaagagaggatctgtggtgtggatccttgattggactctcttctagggccacctgggcgaagaacattcacacagccataactcaggtcaggaacctgatcggaatagaggagtatgtagattacatgccagtcatgaaaagatacagcgctcctttcgagagtgaaggagttctgtaa

SEQ ID NO: 7797 - RNA, 9867 nt, synthetic construct
  misc_feature 1..9867: note = derived and/or modified CDS sequence (wt) from DENV-4__JQ922558__SS-prME
  source 1..9867: mol_type = other RNA
tcaacattaacattgctgtgcttgattcccaccgtaatggcgtttcacctgtcaacaagagatggcgaaccccttatgatagtagcaaaacatgaaagggggagacctcttttgtttaagacaacagaaggaatcaacaaatgcactcttattgccatggacttgggtgaaatgtgtgaggacactgtcacgtacaagtgccctctactggtcaataccgaacctgaagacattgactgctggtgcaatctcacgtccacctgggtcatgtatgggacatgtacccagagcggagaacggagacgagagaagcgctcagtagctttaacaccacattcaggaatgggattggaaacaagggctgagacatggatgtcatcggaaggagcttggaagcacgcccaaagagtagagagctggatactcagaaacccaggattcgcgctcttggcaggattcatggcttacatgattgggcaaacaggaatccagcgaactgtcttctttgttctaatgatgctggtcgccccatcctacggaatgcgatgcgtgggagtggggaacagagactttgtggaaggagtctcaggtggagcatgggtcgatctggtactagaacatggaggatgcgtcacaaccatggcccagggaaaaccaaccctggattttgaactgatcaagacaacagccaaggaagtggctctgctaagaacctattgcattgaagcctcgatatcaaacataactacggcaacaagatgtccaacgcaaggagagccctatctcaaagaggaacaagatcaacagtatatttgccggagagatgtggtagacagagggtggggcaatggctgtggcttgtttggaaaaggaggggttgtgacatgtgcgaagtttttatgcttgggaaagataacaggcaatttggttcaaattgagaaccttgaatacacagtggttgtgacagtccacaacggagacacccatgcagtaggaaatgacatatccaaccatggagtgacagcaacgataactcctaggtcaccatcagtagaggttaaattaccggactatggagaattaacacttgactgtgaacccaggtccggaattgacttcaatgagatgattctaatgaaaatgaaaaagaaaacgtggcttgtgcacaagcaatgggttttggatctacctctaccatgggcagcaggggcagacacatcaaaagttcagtggaattacaaagagagaatggtgacattcaaggtccctcatgccaagagacaggatgtgacagtgctagggtctcaggaaggagctatgcattctgccctcaccggagctacagaagtggattccggtgatggaaaccatatgtttgcaggacatctaaagtgtaaagttcgcatggagaaattgagaatcaaaggaatgtcatacacgatgtgctcaggaaagttctcaattgacaaagagatggcagaaacacagcatgggacgacagtagtgaaagtcaagtacgaaggtgctggagctccatgtaaagtccccatagaaataagagatgtgaacaaggaaaaagtggttgggcgcatcatctcatccaccccttttgctgagcacaccaacagtgtaaccaacatagagttagaacccccctttggggacagttacatagtaataggtgttggagacagtgcattaactcttcattggttcaggaaagggagttccattggcaagatgtttgagtccacatatagaggtgcaaagcgaatggccattctaggtgaaacagcttgggattttggttcagttggtggactattcacatcattgggaaaggctgtgcaccaggtttttggtagcgtgtacacaactatgtttggaggagtctcatggatggttagaatcctaatcgggctcctagtgttgtggattggcacgaattcaagaaacacttcaatggcaatgacgtgcatagctattggaggaatcactctgtttctgggtttcacagttcacgcagacatgggttgtgcggtgtcatggagtgggaaagaattgaaatgtggaagcggaatttttgtagttgacaacgtgcacacctggacagaacagtacaaatttcaaccagagtccccagcaagactagcgtctgcaatattgaatgctcacaaagatggggtctgtggaattagatcaaccacgaggctggaaaatgtcatgtggaagcaaataaccaacgagctaaactatgttctctgggaaggaggacatgacctcactgtagtggccggggatgtgaaaggggtgttaaccaaaggcaagagagcactcacacctccagtgaatgatttgaaatattcatggaagacatggggaaaagcgaaaatcttcactccagaagcaagaaatagcacatttttgatagacggaccagacacctctgaatgccccaatgaacgaagagcatggaactttcttgaggtagaagactatggttttggcatgtttacgaccaacatatggatgaaatttcgagaaggaagttcagaggtgtgtgatcacaggttaatgtcggcggcaatcaaagatcagaaagctgtgcatgctgacatgggctattggattgagagctcaaaaaaccagccctggcagatagggaacgcttccctcattgaagtgaaaacatgtctgtggcccaagacccacacattgtggagcaatggagtgttggaaagccaaatgctcattccaaaagcatatgcaggccctttttcacagcacaattatcgccagggctatgccacgcagaccataggcccatggcacttgggcaaattggagatagactttggagaatgccccggaacaacagtcacaattcaggaggattgtaaccatagaggtccatctttgaggaccactactgcatctggaaaattggtcacgcagtggtgctgccgctcctgcacgatgcctcccttaaggtttttgggagaggatgggtgttggtatgggatggaaattagacccttaagtgaaaaagaagagaacatggtcaaatcacaggtatcggccggacagggtacatcagaaactttctctatggggctgttatgcctgaccttgtttgtggaagaatgcttgaggagaagagtcactaggaaacacatgatattggttgtggtgaccaccctttgtgccatcatcctaggaggtctcacatggatggacttactacgagctcttatcatgttaggggacaccatgtctggtaggatgggaggacagattcacctaaccattatggcagtgttcaagatgtcaccaggatatgtgctgggtgtgtttttaaggaaactcacttcgagagagacagcactaatagtaataggaatggccatgacaacagtgctttcaattccacatgacctcatggaattcatcgatggaatatcactggggttaatcttgctaaaaatggtagctcattttgacaacacccaagtgggaaccttagccctttccttgactttcataagatcaacaatgccattggtcatggcctggaggaccatcatggctgtgttgtttgtggtcacacttattcctctatgtaggacaagctgtcttcaaaagcagtcccattgggtagaaataacagcactcatcctaggagcccaggctctgccagtgtacctaatgaccctcatgaaaggagcctcaaaaagatcctggcctcttaacgagggcataatggctgtgggtttggttagtctcttaggaagcgcccttttaaaaaatgatgtccctctggctggcccaatggtggcgggaggcttacttctggcagcctacgtgatgagtggtagctcagcagacctgtcactagaaaaagccgccaatgtgcattgggatgagatggcagacataacaggctcaagcccaatcatagaagtgaagcaggatgaagatggctccttctccatacgggatgtcgaggaaaccaatatgataacccttttggtgaaactggcactgataacagtgtcaggtctctaccccctggcaattccagtcacaatgaccttatggtacatgtggcaggtgaaaacgcaaagatcaggggccctatgggacgtcccctcacccgctgcagctcagaaagccacactgactgaaggagtgtacaggatcatgcagagagggttgtttgggaaaacccaggttggagtggggatacacatggaaggtgtatttcacacaatgtggcatgtgacaagaggatcagtgatctgccatgagactgggagattagagccgtcttgggctgacgtcaggaacgacatgatatcatacggtgggggatggagactcggagacaaatgggacaaagaagaagatgttcaggttctagccatagaaccaggaaaaaacccgaaacatgtccaaacgaaacccggccttttcaagaccctaactggagaaattggagcagtaacattggatttcaaacccggaacgtctggctctcccatcattaacaagaaaggaaaagttatcggactctatggaaatggagtggttaccaaatcaggtgactatgtcagtgccataacgcaagccgaaagaattggtgacccagattatgaagtggatgaggacatcttccgaaagaaaagattgactataatggatttacaccccggagccggaaagacaaaaagaattctcccatcaatagtcagagaagccttaaaaaggaggctacgaaccttgattttggcccccacgagagtggtggcggccgagatggaagaggcccttcgtggactgccaatccgttatcagaccccagctgtgaaatcagaacacacaggaagagaaattgtggacctcatgtgccatgcaaccttcacagcaaatcctttgtcatcaactagagttccaaattacaaccttatagtgatggatgaagcacatttacaggacctttctattgtcgcggccagaggatacatctcaaccagggtggaaatgggagaggcggcagctatctttatgactgccacccctccaggagcgacagaccccttcccccagagcaacagcccaatagaagatatcgagagggaaattcctgaaaggtcatggaatacagggttcgactggataacagactatcaagggaaaactgtgtggtttgttcccagtataaaagctggaaatgacattgcaaattgcttgagaaagtcgggaaagaaggtgatccagttaagtaggaaaacttttgacacagagtacccaaaaacgaaactcacagactgggattttgtggtcaccacagacatatctgaaatgggggccaactttagagcaaggagagtgatagaccccaggagatgcctcaagccagttatcctaacagatggaccagagagagtcattttagcaggtcccattccagtgactccagcaagtgctgctcagagaagagggcgaataggcaggaacccagcacaagaagacgaccaatacgtcttctccggagacccactaaaaaatgatgaagatcatgcccactggacagaagcaaagatgctgcttgataatatctataccccggaaggaatcattccaacattgtttggtccagaaagggaaaaaatccaagccattgatggagagttccgcctcagaggggaacagaggaaaacttttgtggaactaatgaggagaggagaccttccggtgtggctgagctataaggtggcttctgctggtatttcttacaaagaccgggaatggtgcttcacaggggaaagaaataaccaaattttagaagaaaatatggaggttgaaatttggactagagagggagaaaagaaaaaactaaggccaaaatggttagatgcacgtgtttatgctgaccccatggctttgaaggatttcaaggagtttgccagcggaagaaagagcataacccttgacatcctaacagagattgccagtttgccaacttatctttcctctagggctaagctcgctcttgacaacatagtcatgctccacacaacagagagaggagggagggcctaccaacacgccctgaacgaactcccggagtcactggaaacactcatgctagtagccttactaggtgctatgacagcaggcatcttcctgtttttcatgcaaggaaaaggaatagggaaattgtcaatgggtttgatggccattgcggtagctagtggcttgctctgggtagcagaaattcagccccagtggatagcggcctcaatcatactggagtttttttctatggcactgttgataccagaaccagaaaaacaaaggaccccacaagacaatcaattgatctatgtcatattgaccattctcaccattattggtctcatagcagccaacgagatggggctgattgaaaaaacaaaaacggattttgggttttaccaggtaaaaacagaaaccaccatcctcgatgtagatttgagaccagcttcagcatggacgctctatgcggtagccactactattttgactcctatgctgagacacaccatagaaaacacgtctgctaacttatctctagcggccattgccaaccaagcagctgtcctaatggggcttggaaaaggatggccacttcacagaatggaccttggtgtgccgctgttggcaatgggatgttactctcaagtgaacccaacaactctgacagcatccttagtcatgctttcagtccattatgcaataataggtccaggactgcaggcaaaagccacaagagaggctcagaaaaggtcagctgctgggatcatgaagaaccccacggtggacgggataacagtaatagacttagaaccaatatcctatgacccaaaatttgaaaagcaattagggcaagtcatgctactagcattgtgtgctggacaactactcttgatgagaacaacatgggctttctgtgaagtcttgactttggccacaggaccaatcttgaccttgtgggagggcaacccgggaaggttttggaacacgactatacccgtatccactgccaatattttcaggggaagttacttggcgggagctggactagctttttcgctcataaagaacgcacaaacccccaggaggggaaccgggaccacaggagagacactgggagagaagtggaagagacagctaaactcattagacaggaaggagtttgaagagtacaaaagaagtggaatatttgaagtggacaggcacgaaatcaaatacaccttaaaggatgggtccaaaatcaaccatgccatgtccacagggtccatcaagatcagagggattgatgaaagagggatggtaaaacccaaaggaaaagttgtggaccaagggtgcgggagaggaggatggtcccattacactgcgacagctaagaaagtgactgaggtgaaagggtacacaaaaggaggtccaggacatgaagaaccgattcccatggctacctatggctggaatttggtcaaactccattcaggagttgacgtgttctataaacccactgagcaagtggacaccctgctctgtgacattggggagtcatcttccaatccgacgatagaagaaggaagaacattgagagttttgaagatggtggaaccatggctctcttcaaaacctgaattctgcatcaaagtccttaacccctacatgccaacagtcatagaagagctggagaaactacagagaaaacatggtggaagtcttgtcagatgcccgctatccaggaattctactcatgagatgtactgggtgtcaggtgtgtcgggaaacatcgtgagctctgtgaacacaacatcaaagatgttgttaaacaggtttaccacaaggcacagaaaacctacttatgagaaggatgtagaccttggagcagggacgagaagtgtctccattgagacagaaaaaccagacatgacgattattgggagaaggcttcagcggttgcgagaagagcacaaagaaacttggcactacgatcaggaaaacccatacagaacctgggcgtatcacggaagctatgaagctccttcgacaggctcagcatcctccatggtgaacggggtagtaaaactgctgacaaagccttgggacgtaattccaatggtgacccagctagccatgacagacacaaccccttttgggcaacagagagagttcaaagagaaggtgtatacctctacaccccaccccaaaccttggacacgaatggttatgaccacaacagccaattggctgtgggccctcggtgggaagaagaaaagtcccagactgtgcacatgggaagagttcatctcaaaagttaggtcaaacgcagccataggcgcagtttttcaagaagaacagggatggacatcagctagtgaagctgtgaatgacagccggttttgggaactggttgacaaagaaagggctctgcaccaggaagggaaatgtgaatcgtgtgtttacaacatgatgggaaaacgtgagaaaaagctaggagagtttggtagagccaaaggaagccgagcaatctggtacatgtggctgggagcgcggtttctggaatttgaagccctgggttttttgaatgaagatcactggtttggcagagaaaattcatggagtggggtggaaggggaaggtttgcatagattgggatatatcctggaggacatagacaagaaggatggagacctgatatatgctgatgacacagcaggttgggacacaagaatcactgaagatgaccttctgaatgaagaactgatcacggaacagatggctcctcatcataggatcctagccaaagccattttcaaacttacttatcatagcaaagtgatgaaagtcctcagacctacaccgaaaggagcggtaatggatatcatatccaggaaagaccaaagaggtagtggacaggttggaacatatggtttgaacacattcaccaacatggaagtacaactcatccgccaaatggaagctgaaggagtcattacacaagatgacatgcagaacccaaaagggttgaaagaaagagttgagaaatggctgaaggagtgtggtgtcgacaggttaaagaggatggcaatcagtggagacgattgtgtggtgaagcccctggacgagaggttcagcacttccctcctctttttgaacgacatgggaaaggtgaggaaagacattccgcagtgggaaccatctaagggatggaaaaactggcaagaggttcccttttgctcccaccactttcacaagattttcatgaaagatggccgctcactagttgttccatgtagaaaccaggatgagctgatagggagagccagaatctcacagggggctggatggagtttaagagaaacagcctgtctgggcaaagcttacgcccagatgtggtcgctcatgtactttcacagaagggacctgcgtttagcctccatggccatatgctcagcagttccaacggaatggttcccaacaagcagaacaacatggtcaatccacgcccatcaccagtggatgaccactgaagacatgctcaaagtgtggaacagagtgtggatagaagacaaccctaacatgactgacaagaccccagtccattcgtgggaagacgtaccttacctagggaaaagagaggacttgtggtgtggatccttgattggactttcttccagagccacctgggcaaagaacattcacacagccataacccaagtcaggaacctgatcgggaaagaggagtatgtagattacatgccagtcatgaaaagatacagcgctcccatcgagagtgaaggagttctgtaa

SEQ ID NO: 7798 - RNA, 9867 nt, synthetic construct
  misc_feature 1..9867: note = derived and/or modified CDS sequence (wt) from DENV-4__JQ922559__SS-prME
  source 1..9867: mol_type = other RNA
tcaacaataacattgttgtgcttgattcccaccgtaatggcgtttcacttgtcaacgagagatggcgaaccccttatgatagtggcgaaacacgaaagggggagacctctcttgtttaagacaacagaaggaatcaacaagtgcactcttattgccatggacctgggtgaaatgtgcgaggacaccgtcacgtataaatgccctttactggtcaataccgaacccgaagacattgattgctggtgcaatctcacgtctgcctgggtcatgtatgggacatgcacccaaagtggggaacggagacgagagaagcgctcagtagctctaacaccacattcaggaatgggattggaaacaagggctgaaacatggatgtcatcggaaggagcttggaaacacgctcagagggtagagagttggatactcagaaacccaggattcgcgctcttggcaggatttatggcctacatgattgggcaaacaggaatccagcgaacagtcttctttattctaatgatgctggtcgccccatcctacggaatgcgatgcgtaggagtggggaacagagactttgtggaaggagtctcaggtggagcatgggtcgatctggtactagaacatggaggatgcgtcacaaccatggcccagggaaaaccaaccctggattttgaactgatcaagacaacagccaaggaagtggctctgttaagaacctattgcattgaggcttcgatatcaaacataactacggcaacaagatgtccaacgcaaggagagccctatctcaaagaggaacaagatcaacagtatatttgccggagagatgtggtagacagagggtggggcaatggctgtggcttgtttggaaaaggaggagttgtgacatgtgcgaagtttttatgctcgggaaagataacaggcaatttggttcaaattgagaaccttgaatacacagtggttgtgacagtccacaacggagacacccatgcagtaggaaatgacatatccatccacggagtgacagctacgataactcctaggtcaccatcagtagaggtcaaattaccggactatggagaattaacacttgactgtgaacccaggtccggaattgacttcaatgagatgattctaatgaaaatgaaaaagaaaacgtggcttgtgcacaagcaatggtttttggatctacctctaccatggacagcaggggcagacacatcagaagttcagtggaattacaaagagagaatggtgacattcaaggtccctcatgccaagagacaggatgtgacagtgctagggtctcaggaaggagccatgcattcagccctcaccggagccacagaagtggattccggtgatggaaaccacatgtttgcaggacatttgaagtgcaaagttcgtatggagaaattgaggatcaagggaatgtcatacacgatgtgctcaggaaagttctcaattgacaaagagatggcagaaacacagcatgggacaacagtggtaaaagtcaagtatgagggtgctggagctccatgtaaagttcccatagagataagagatgtgaacaaggaaaaagtggttgggcgtatcatctcatctactccttttgctgagaacacctacagtgtgaccaatatagaattggaacccccctttggggatagctacataataataggtgtaggagacagtgcattaacactccattggttcaggaaagggagttccattggcaagatgtttgagtccacatacagaggcgcaaagcgcatggccattctaggtgaaacagcttgggattttggttctgttggtggactgctcacatcattgggaaaggctgtacaccaggtttttggtagtgtgtatacaactatgtttggaggagtctcatggatggttagaatcctaatcgggctcttagtattgtggattggcacgaattcaagaaacacctcaatggcaatgtcgtgcatagctgttggaggaatcactttgtttctgggtttcacagttcatgcagacatgggttgtgcggtgtcatggagtgggaaagaattgaaatgtggaagcggaatttttgtaattgacaacgtgcacacttggacagaacagtacaagtttcaaccagagtcaccagcgagactggcgtcagcaatactgaatgcccacaaagatggagtctgtggaattagatcaaccacgaggctggaaaatgtcatgtggaagcaaataaccaatgagttaaactatgtcctctgggaaggaggacatgacctcactatagtggccggggacgtgaaaggggtgttgtccaaaggcaagagagccctcgcacctccagtgaatgacctgaaatattcatggaagacatggggaaaggcaaagatcttcactccagaaacaagaaacagtacatttttaatagacggaccagacacctccgaatgccccaatgaacgaagagcatggaactttcttgaggtagaagactatggatttggcatgtttacgaccaacatatggatgaaatttcgagaaggaagttcagaagtgtgtgaccacaggttgatgtcagcggcaatcaaagaccagaaagctgtgcatgctgatatgggctattggatagagagctcaaaaaaccagacctggcagatagagaaggcatccctcattgaagtgaaaacatgcctgtggcccaagacccacacattgtggagcaatggagtgctggaaagccagatgctcatcccaaaagcatatgcaggccctttttcacagcacaattaccgccagggctatgccacgcagaccgtgggcccatggcacttgggcaaactggagatagactttggagaatgccccggaacaacagtcactattcaagaggattgtgaccatagaggcccgtctctgaggaccaccactgcatctggaaaactggtcacgcagtggtgctgccgctcctgcacgatgcctcccctaaggtttttaggagaggatggatgttggtatgggatggaaattaggcccttgagtgaaagagaagagaacatggtcaaatcacaggtatcggccggacagggtacatcagaaactttttctatggggttgttatgcttgactttgtttgtggaagaatgcttgaggagaagagtcaccaggaaacacatgatattggttgtggtgaccaccctttgtgccatcatcttaggaggtctcacatggatggacttactgcgagcccttatcatgctaggggacaccatgtctagtagaatgggaggacagattcacctagccatcatggcagtgttcaagatgtcaccaggatacgtgctgggtatatttttgaggaaactcacctcaagagagacagcactaatggtaataggaatggccatgacaacggtgctttcaattccacatgaccttatggaatttattgatggaatatcactagggttgatcttgttaaaaatggtaacacattttgacaacactcaaatgggaaccttggccctttccttgaccttcataaaatcaacaatgccattggtcatggcttggaggaccataatggctgtgttgtttgtggtcacactcattcctctatgcaggacaagctgtcttcagaagcagtcccattgggtggaaataacagcactcatcctgggagcccaggctctgccagtgtacctaatgactctcatgaaaggagcctcaaagagatcctggccccttaacgagggtataatggctgtgggcttggtcagtctcttgggaagcgcccttctaaagaatgatgtccctttagctggcccaatggtggcaggaggcttacttctggcagcctacgtgatgagcggcagctcagcagacctgtcactagagaaggctgccaatgtgcagtgggatgagatggcagacataacaggctcaagcccaatcatagaagtgaagcaagatgaagatggctctttctccatacgagacgttgaggaaaccaacatgataaccctcctggtgaagctggcactgataacagtgtcaggtctctaccccttggcaattccagtcacaatgaccctatggtacatgtggcaagtgaaaacacaaagatcaggagccctgtgggacgtcccctcacctgctgccgctcagaaagccacactgactgaaggagtgtacaggatcatgcaaagagggttgtttgggaaaactcaggttggagtagggatacacatggaaggtgtatttcatacaatgtggcatgtaacaagaggatcagtgatttgccatgagagtgggagactggagccatcttgggctgacgtcaggaacgacatgatatcatacggtgggggatggaggctcggagacaaatgggacaaagaagaagacgttcaagttctagctatagaaccaggaaaaaatccgaaacatgtccaaacgaaacccggccttttcaaaaccctaactggagaaattggagcagtaacattagacttcaaacccggaacatccggttctcccatcattaacaggaaaggaaaagttatcggactctacggaaatggggtagttaccaaatcaggtgattacgtcagcgccataacacaagctgaaagaattggtgagccagattacgaagtggatgaggacatctttcgaaagaaaagattaactataatggacttacatcccggagccggaaagacaaaaagaattctcccatcaatagtcagagaggccttaaaaaggaggctacgaaccctgattctggctcccacgagagtggtggcggccgaaatggaagaagctctacgtggactgccaatccgttatcagaccccagctgtgttatcagaacacacaggaagagagatcgtagacctcatgtgtcatgcaaccttcacgacaagacttttatcatcaaccagggttccaaattacaaccttatagtgatggatgaagcgcatttcacagacccttctagtgtcgcagctagaggatacatctcaaccagggtggaaatgggagaggctgcagctatcttcatgactgcaacccctcctggaacaacagatcccttcccccagagcaacagcccaatagaagacatcgagagagaaattccagaaaggtcatggaacacagggtttgactggataacagactaccaagggaaaactgtgtggtttgttcccagcataaaagctggaaatgacattgcaaattgcttgagaaaatcggggaagaaggtgatccaattgagtagaaaaacctttgacacggagtatccaaaaacgaaactcacggactgggattttgtggtcaccacagacatatctgtaatgggggccaattttagagctgggagagtgatagaccccaggagatgccttaagccagttatcataactgacgggccggagagagttattttagcgggtcccattccagtgactccagcaagcgctgctcagagaagagggcgaataggtaggaacccagcacaagaagatgaccaatatgtcttctccggagacccactaaggaatgatgaagatcatgcccactggactgaagcaaagatgcttcttgacaatatctacaccccagaagggatcattccaacattgtttggtccggaaagggaaaaaacccaagccattgatggagagttccgcctcagaggggaacaaaggaagacttttgtagaattaatgaggagaggagaccttccggtgtggctgagctacaaggtagcttctgctggtatctcttacaaagaccgggaatggtgctttacgggggaaaggaacaaccaaattttagaagagaatatggaggttgaaatttggactagagagggagagaagaaaaaactcaggccaaaatggttagatgcacgtgtttacgctgaccccatggctttgaaggatttcaaggagtttgccagtggaagaaagagcataaccctcgacatcctaacagaaattgccagtttgccaacatacctttcctctagagctaagctcgcccttgacaacatagtcatgctccacacaacagaaagaggagggaaggcctatcaacatgccctgaacgaactcccagagtcactagaaacactcatgcttgtagctttactaggagccatgacagcaggcatcttcttgttcttcatgcaaggaaaaggaataggggaattgtcaatgggtttgatagctatcgcgggagctagtgggttgctctggggaacaaaaaccccccccccctggggagcggcctcaaatatactggagttttttctcatggtgctgttgataccagaaccagaaaaacaaaggaccccacaagacaaccaattgatctacgttatattgaccattctcactattattggtctcgtggcagccaatgagatggggctaattgaaaaaacaaaaacggattttgggttttaccaggtaaaaacagaaactaccattcttgatgtggacttgagaccagcctcagcatggacgctctatgcagtagccaccactatcttgactcccatgctgagacacaccatagaaaacacgtctgcaaacctatctttagcggccattgccaaccaagcagccgtcttgatggggcttggaaaaggatggccgctccacagaatggaccttggtgtgccgctattggcaatgggatgctattcccaagtgaacccaacgactttaatagcatccttagtcatgcttttagtccattatgcaataataggtccaggattgcaggctaaagccacaagagaggctcagaaaaggacagctgctgggatcatgaagaaccccacggtggacgggataaccgttatagatctagaacccatatcctatgacccaaaatttgaaaagcagctagggcaagtcatgttactagtcctgtgtgctggacagctactcctgatgagaacaacatgggccttctgtgaagtcttgactttggccacaggaccaatcttgaccctgtgggagggcaacccgggaaggttttggaacacgactatagccgtgtccactgccaacattttcaggggaagctatttggcgggagctggattggccttttcgctcataaagaatgcacaaacacccaggaggggaactggggtcacaggagagacactgggagaaaagtggaagagacagctgaactcactagataggaaggagtttgaagagtacaaaagaagtggaatactagaagtggacaggactgaagccaaatctgccctgaaagatgggtctaaaatcaagcaagcagtgtccagagggaccagcaagattagatggattgttgaaagagggatggtaaagccaaaagggaaagttgtggaccttggttgcgggagaggaggatggtcgtactacatggcgacactcaagaacgtgaccgaggtgaaagggtacacaaaaggaggtccaggacatgaagaaccaattcccatggctacttatggctggaacttggtcaaactccattcacgggttgacgtgttctacaaacccactgagcaagtggacaccctgctctgtgatattggggagtcatcctctaatccgacgatagaggaaggaagaacattaagagttttgaagatggtggagccatggctctcttcaaaacctgaattctgcatcaaagtccttaacccctacatgccaacagtcatagaagagctggagaaactgcagagaaaacatggtggaagtcttgtcagatgcccgctatccaggaattccactcatgagatgtattgggtgtcaggtgtgtcaggaaacattgtgagctctgtgaacacaacatcaaagatgttgttgaacagatttaccacaaagcataggaaacccacttatgagaaggacgcagatcttggagcaggaacgagaagtgtctccactgaaacggaaaaaccagacatgacaatcatcgggagaagactccagcgattgcaagaagagcaccaagaaacttggcactatgatcaggaaaatccatacagaacctgggcgtatcatggaggttatgaagctccttcgacaggctcagcatcctccatggtgaacggggtagttaaactgctaacaaaaccttgggacgtgattccaatggtgacccagttggctatgacagacacaaccccttttgggcaacagagagtgttcaaagagaaggttgacaccagaacaccacagccaaaacccggtacacgaatggttatgaccacgacagccaactggctgtgggctctcctcgggaagaagaagaatcccagactgtgcacaagggaagagttcatctcaaaagttaggtcaaatgcagccataggcgcagtctctcaggaagaacagggatggacgtcatcctttgaagctgtgaatgacagccgattttgggaactggttgacaaagaaagggctctgcaccaggaagggaaatgtgaatcatgtgtctataacatgatgggaaaacgtgagaaaaaattaggagagtttggcagagccaagggaagccgggcaatctggtacatgtggctgggagcgcggtttctggaatttgaagccctggggtttctgaatgaagatcactggtttggcagggaaaactcatggagtggagtggaaggggaaggtctgcataggttgggatatatcctggaggacttagataaaagggataggagcctggtatttgctgatgacacagctggttgggacaccaagattcccgaagatgaccttctgaaggaaaaaccgatcccgggaccaatggcccctcatcaaaggatcccagccagagccattttcaaactaacttatcaaaacaaagtggtaaaagtcctcagacttaaattgaaaggagcagtgatggacatcatatctaggaaagaacaaagaggtagtggacaggttggaacatatggtttgaacacattcaccaatatggaagtacaactcatccgccaaatggaagctgaaggagtcatcacacgagatgacatgcataacccaaaagggttgaaagaaagagtcgagaaatggctgaaagagtgtggtgtcgacaggttagagaggatggcaatcagtggagatgattgtgtggtgaagcctctggatgagaggttcagcacttccctcctctttttgaacgacatgggaaaggtgaggaaagacattccgcaatgggaaccatccaagggatggaaaaactggcaagaggttcctttttgctcccaccactttcacaagatctttatgaaggatggccgctcactggttgttccatgtagaaaccaggatgaactgatagggagagccagaatctcgcaaggggctggatggagtttaagagaaacagcctgtctgggcaaggcttacgcccagatgtggtcgctcatgtactttcatagaagggacctgcgcttagcctccatggccatatgctcagcagtcccaacggaatggtttccaacaagcagaacaacatggtcaatccacgctcatcatcagtggatgaccactgaagatatgctcaaagtatggaacagagtgtggatagaagacaaccctaatatgactgacaagactccagttcattcgtgggaagacataccttacctagggaaaagagaggatttgtggtgtggatccttgattggactctcttctagggccacctgggcgaagaacattcacacagccataactcaggtcaggaacttgatcgggatagaggggtatgtggattactttctactcataaaatggtacagcgctcctttcgagagtgaaggagttctgtaa

SEQ ID NO: 7799 - RNA, 9867 nt, synthetic construct
  misc_feature 1..9867: note = derived and/or modified CDS sequence (wt) from DENV-4__KF955510__SS-prME
  source 1..9867: mol_type = other RNA
tcaacaataacattgctgtgcttgattcctactgtaatggcgtttcacttgtcaacgagagatggtgaacccctcatgatagtggcgaaacacgaaagggggagacctctcttgtttaagacaacagaaggaatcaataagtgcactcttattgccatggacctgggtgagatgtgcgaggacaccgtcacgtataaatgccccttactggtcaataccgaacccgaagacattgattgctggtgcaatctcacgtctgcctgggttatgtatgggacatgcacccaaagtggagaacgaagacgagagaagcgctcagtagctctaacaccacattcaggaatgggattggaaacaaggactgaaacatggatgtcatcggaaggggcttggaaacacgcccagagggtagagagttggatactcagaaagccaggattcgcgctctcggcaggttttatggcctacatgatcgggcaaacaggaatacagcgaacagtctttttcattctaatgatgctggtcgccccatcttacggaatgcgatgcgtaggagtggggaacagagactttgtagaaggagtctcaggtggagcatgggtcgatctggtgctagaacatggaggatgtgtcacaaccatggcccagggaaagccaaccttggattttgaactgatcaagacaacagccaaggaagtggccctattaagaacctattgcattgaagcttccatatcaaacataaccacggcaacaagatgtccgacgcaaggagagccttacctcaaagaggaacaagatcaacagtacatctgccggagagatatggtagatagagggtggggcaacggctgtggcttgtttgggaaaggaggagttgtgacatgtgcgaagttttcatgctcggggaaaataacgggcaacttagtccagattgagaaccttgaatacacagtggttgtaacagtccacaatggagacacccatgctgtaggaaatgacacatccaaccacggagagacagctacgataacccccaggtcaccatcggttgaagttagactaccagactatggagaattgacacttgactgtgaacctaggtccggaattgactttaatgagatgattctgatgaaaatgaaaacgaaaacgtggctcgtgcacaagcaatggttcttggatctacctctaccatggacagcaggagcagacacgtcagaagttcactggaatcacaaagagagaatggtgacattcaaggttcctcatgccaagagacaggatgtgacagtgctaggatctcaggaaggagccatgcattcagccctcgccggagccacagaagtggattccggtgatggaaaccatatgtttgcaggacacttaaagtgtaaagttcgtatggaaaagttgaggatcaagggaatgtcatacacgatgtgctcaggaaagttctcaattgataaagagatggcagaaacacagcatggaacaacagtggtaaaggtcaagtatgagggtactggagctccatgtaaagttcccatagagataagagatgtgaacaaggaaaaagtggttgggcgcatcatctcatccaccccttttgctgagaataccaacagtgtgaccaatatagaattggaacctccttttggggatagctacatagtgataggtgcgggagacagtgcattaacactccattggttcaggaaagggagctccattggtaagatgtttgagtccacatacagaggtgcaaagcgcatggccattctaggtgaaacagcctgggattttggttctgttggtggactgctcacgtcattaggaaaggctgtacaccaggtttttggcagtgtgtatacaaccatgtttggaggagtctcgtggatggtcagaatcctaatcgggctcttagtgctgtggattggcacgaattcaagaaacacttcgatggctatgtcgtgcatagttgttggaggaatcaccctgtttctgggctttacagttcatgcagacatgggttgtgtggtgtcatggagtgggaaagagttgaaatgtggaagcggaatttttgtaattgacaacgtgcacacttggacagaacagtacaaatttcaaccagagtctccagcgcgactggcgtcggcaatactgaatgcccacaaagatggggtctgtggaattagatcaaccacgaggctggaaaatgtcatgtggaagcaaataaccaatgagttaaactatgttctctgggaaggaggacatgacctcaccgtagtggccggggatgtgaaaggggtgttgtccaaaggcaagagagcactcgcacctccagtgaatgacctgaaatactcatggaagacatggggaaaagcaaagatctttactccagaaacaagaaacagcacatttttggtggacggaccagacacctccgaatgccccaatgaacgaagagcatggaactttcttgaggtggaagactatggatttggcatgttcacgaccaacatatggatgaaatttcgagaaggaagttcagaagtgtgtgaccacaggctgatgtcggcggcaatcaaagaccagaaagctgtgcatgctgacatgggctattggatagagagctcaaaaaaccagacctggcagatagagaaggcatcccttattgaagtgaaaacatgtctgtggcccaagacccacacattgtggagcaatggagtgttggaaagccagatgctcatcccaaaagcatatgcaggccctatttcacagcacaactatcgccagggctatgccacgcagaccgtgggcccatggcacctgggcaaattggagatagattttggagagtgccccggaacaacagtcactattcaagaggattgtgaccatagaggtccatctttgaggaccaccactgcatctggaaaattggtcacgcagtggtgctgtcgctcctgcacgatgcctcccttaagattcttaggagaggatggatgctggtatgggatggaaatcaggcccttgaatgaaaaagaagagaacatggtcaaatcacaggtatcagccggacagggtacatcagagactttttctatggggctgttatgcctgactttgtttgtggaagaatgcttgaggagaagagtcaccaggaaacacatgatattggttgtggtgaccaccctttgtgccatcattttaggaggtcttacatggatggacttactgcgtgcccttatcatgctaggggacaccatgtctggtagaatgggaggacagattcatctagccatcatggcaatgttcaagatgtcaccaggatacgtgttgggtatatttctgaggaaactcacctcaagagagacagcactaatggtaataggaatggccatgacaacggtgctttcaattccacatgaccttatggaatttattgatggaatatcattagggttaatcttactaaaaatggtaacacattttgacaacactcaagtgggaaccttagccctctccttgaccttcataaaatcaacaatgccattggtcatggcttggaggaccataatggctgtgttgtttgtggtcacactcattcctctatgtaggacaagctgtcttcaaaagcagtctcattgggtggaaataacagcactcatcctgggagcccaggctctgccagtatacctaatgactctcatgaaaggagcctcaaaaagatcttggccccttaacgagggtataatggctgtgggcttggtcagcctcttaggaagcgcccttctaaagaatgatgtccctttggctggcccaatggtggcaggaggcttacttctggcagcctacgtgatgagcggcagctcagcagacctgtcactagagaaggctgccaatgtgcagtgggatgagatggcagacataacaggctcaagcccaatcatagaagtgaagcaggatgaagatggctctttctccatacgggacgtcgaggaaaccaacatgatcaccctcctggtgaaactggcactgataacagtgtcaggtctctaccccttggcaattccagtcacaatgaccttatggtacatgtggcaagtgaaaacacaaagatcaggagccctgtgggacgtcccctcacctgctgccgctcagaaagccacactaactgagggagcatacaggatcatgcaaagagggttgtttgggaaaactcaggttggagtagggatacacatggaaggagtatttcatacaatgtggcatgtaacaagaggatcagtgatttgccatgagagtgggagactggagccatcttgggctgacgtcaggaacgacatgatatcatacggtgggggatggaggctcggagacaaatgggataaagaagaagatgtccaagttctagctatagaaccaggaaaaaatccgaaacatgtccaaacgaaacccggccttttcaaaacccttactggagaaattggagcagtaacattggacttcaaacccggaacatccggttctcccatcattaacaggaaaggaaaagtcatcggactctacggaaatggggtagttaccaaatcaggtgattacgttagtgccataacacaagctgaaagaattggtgagccagattatgaagtggatgaggacattttccgaaagaaaagattaactataatggatttacatcccggagccggaaagacaaaaagaatcctcccatcaatagttagagaagccttaaaaaggaggctgcgaaccttgattctggctcccacgagagtggtagcggccgaaatggaagaagcgctacgtggactgccaatccgttatcagaccccagctgtgaaatcagaacacacaggaagagagattgtagacctcatgtgtcatgcaaccttcacaacaagacttttatcatcaaccagggttccaaattacaacctcatagtgatggatgaagcgcatttcacagacccttctagtgttgcagctagaggttatatctcaaccagggtggaaatgggagaggctgcagctatctttatgactgcaacccctcctggaacgacagatcccttcccccagagcaacagcccaatagaagacatcgagagagaaatcccagaaaggtcatggaacacagggtttgactggataacggactaccaagggaaaactgtgtggtttgttcccagcataaaagctggaaatgacattgcaaattgcttgagaaaatcgggaaagaaggtcatccaattgagcaggaaaacctttgacacagagtatccaaaaacgaaactcacggactgggattttgtggtcaccacagacatatctgaaatgggggccaattttagagctgggagagtgatagaccccaggagatgcctcaagccagtaatcttaactgatgggccagagagagttattttagcgggtcccattccagtgactccagcaagcgctgctcagagaagagggcgaataggtaggaacccagcacaagaagatgaccaatatgtcttctccggagacccactaaggaatgatgaagatcacgcccactggactgaagcaaagatgcttcttgataatatctacaccccagaaggaatcattccaacattgtttggtccagaaagggaaaaaacccaagccattgacggagagttccgcctcagaggggaacaaaggaagacctttgtagaattaatgaggagaggagaccttccggtgtggctgagctacaaggtagcttctgctggcatctcttacaaagaccgggagtggtgcttcacgggggaaaggaataaccaaatcttagaagaaaacatggaggttgaaatttggactagagagggagagaagaaaaaactcaggccaaaatggttagatgcacgtgtttacgctgatcccatggctttgaaggattttaaggagtttgccagtggaagaaagagtataaccctcgacatcttaacagaaattgccagtttgccaacgtacctttcctctagggctaagctcgcccttgacaacatagtcatgctccacacaacagaaagaggagggaaggcctaccaacacgccctgaacgaactcccagagtcactagaaacactcatgcttgtagctttattgggagccatgacagcgggcatcttcctattcttcatgcaaggaaagggaatgggaaaattgtcaatgggtttgatagccattgcggtagctagtggcttgctttgggtagcagaaatccagccccagtggatagcggcctcaatcatattggagttttttctcatggtgctgttggtaccagaaccagaaaaacaaaggaccccacaagacaatcaattgatctacgtcatattgaccattctcaccatcattgctctcgtggcagccaatgagatggggctaattgaaaaaacaaaaacggactttgggttttaccaggcaaaaacagaaaccaccatccttgatgtggacttgagaccagcttcagcatggacgctctatgcagtagccaccactatcttgactcccatgctgaggcacaccatagaaaacacgtctgcaaacctatctttggcggccattgccaaccaagcagccgtcttaatggggcttggaaaaggatggccgctccacagaatggacctcggtgtgccgctattggcaatgggatgctattcccaagtgaacccaacgactttgacagcatccttagtcatgcttctggtccattatgcaataataggtccaggattgcaggccaaagccacaagagaggctcaaaaaaggacagctgctgggatcatgaagaaccccacagtggacgggataacagttatagatctagaaccaatttcctatgacccaaaatttgaaaagcagctggggcaagtcatgctactagttctgtgcgctggacagctactcttgatgagaacaacatgggccttctgtgaagtcttgactttggccacaggaccaatcttgaccttgtgggaaggcaacccggggaggttttggaacacgaccatagccgtgtccactgccaacattttcaggggaagctacctggcgggagctggattggccttttcgcttataaagaatgcacaaacccctaggaggggaactgggaccacaggagagacactgggagaaaaatggaagagacagctaaattcgctagataggaaggggtttgaagagtacaaaagaagtggaatactagaagtggacaggactgaagccaagtctgccctaaaagatgggtctaaaatcaagtatgcagtgtccagagggactagcaagattagatggattgttgaaagagggatggtaaagccaaaagggaaagttgtggatcttggttgcgggagaggaggatggtcgtactatatggcgacactcaagaacgtgaccgaggtgaaaggatatacaaaaggaggtccaggacatgaggaaccgattcccatggctacctatggctggaacttggtcaaactccattcaggggttgacgtgttctacaaacccactgagcaagtggacaccctgctctgtgatattggggagtcatcttctaatccgacgatagaggaaggaagaacattacgagttttaaagatggtggagccatggctctcttcaaaacctgaattttgcatcaaagtcctcaatccctatatgccaacagttatagaggagctggagaaactgcagagaaaacatggtggaagtcttgtcagatgcccgctatccaggaactccacccatgagatgtattgggtgtcaggtgtgtcaggaaacatcgtgagttctgtgaacacaacatcaaagatgttgttgaacagatttaccacaaggcacaggaaacccacttatgagaaggacgcagaccttggagcaggaacgagaagtgtctccaccgaaacagaaaaaccagacatgacaatcatcgggagaagactccagcgattgcaagaagagcacaaagaaacttggcactatgatcatgaaaatccatacagaacctgggcgtatcatggaagctatgaagccccttcgacaggctcagcatcctccatggtgaacggggtagttaaactgctgacaaaaccctgggacgtggttccaatggtgacccagttggccatgacagacacaaccccttttgggcaacagagagtgttcaaagagaaggttgacaccagaacaccacagccaaaacccggtacacgagtggtcatgaccacgacagccaactggctgtgggctctcctcgggaggaagaaaaatcccagactgtgcacaagggaagaattcatctcaaaagttaggtcaaatgcagccataggcgcagtctttcaggaagaacagggatggacatcagccagtgaagctgtgaatgacagccgattttgggaactggttgacaaagaaagggctttgcaccaggaagggaaatgtgaatcatgtgtctataacatgatgggaaaacgtgagaaaaagttaggagaatttggcagagccaagggaagccgagcaatctggtacatgtggctgggagcgcggtttctggaatttgaagccttgggctttctgaatgaagatcactggtttggcagggaaaactcatggagtggagtggaaggggaaggtctgcataggttgggatatatcttggaggacatagataagaaggatggagatcttatatatgctgatgacacagcaggctgggacacaagaatcactgaagatgaccttctgaatgaagagctgatcacggaacagatggcccctcatcataaaatcctagccaaagccattttcaaactaacttatcaaaacaaagtggtgaaagtcctcagacccacaccgaaaggagcagtgatggacattatatccaggaaagatcaaagaggtagtggacaggttggaacatatggtttgaacacattcactaacatggaagtgcaactcatccgccaaatggaagctgaaggagtcatcacacgagatgacatgcataacccaaaaggtttgaaagaaagagttgagaaatggctgaaagagtgtggtgtcgacaggttaaagaggatggcaatcagtggagacgattgtgtggtgaagcctttggatgagaggttcagcacttccctcctctttttgaacgacatgggaaaagtgaggaaagacattccgcaatgggaaccatccaaggggtggaaaaactggcaagaggttcccttttgctcccaccactttcacaagatctttatgaaggatggccgttcactggtcgttccatgtagaaaccaggatgaactaatagggagagctaggatttcgcaaggggctggatggagtttaagagaaacagcctgtctgggcaaagcttacgcccagatgtggtcgctcatgtactttcatagaagggacctacgtttagcctccatggctatatgctcagcagtcccaacggaatggtttccaacaagcagaacaacatggtcaatccacgctcatcatcagtggatgactactgaagatatgctcaaagtgtggaacagagtgtggatagaagacaaccccaatatgattgacaaaactccagttcactcgtgggaagacataccttacctagggaaaagagaggatttgtggtgtggatccttgattggactctcttctagggccacctgggctaagaacattcacacagccataacccaggtcaggaacctgatcgggaaagaggagtatgtggattacatgccagtcatgaaaagatacagcgctcatttcgagagtgaaggagttctgtaa

SEQ ID NO: 7800 - RNA, 9867 nt, synthetic construct
  misc_feature 1..9867: note = derived and/or modified CDS sequence (wt) from DENV-4__GQ868594__SS-prME
  source 1..9867: mol_type = other RNA
tcaacaatgacattgctgtgcttgattcccaccgtaatggcgtttcacttgtcaacaagagatggcgaaccccttatgatagtggcaaaacacgaaagggggagacctctcttgtttaagacaacagagggaatcaacaaatgcactcttattgccatggacctgggtgaaatgtgtgaggacaccgtcacgtatgaatgccctctactggtcaataccgaacctgaggacattgattgctggtgcaatctcacgtctgcctgggtcatgtatgggacatgcactcagagtggggaacggagacgggagaagcgctcagtagccctaacaccacattcaggaatgggattggagacaagggctgagacatggatgtcatcggaaggggcttggaaacatgctcagagggtagagagttggatactcagaaacccaggattcgctctcttggcaggatttatggcctatatgattgggcaaacaggaatccagcgaacagtcttctttgttctaatgatgctggtcgccccatcctacggaatgcgatgcgtgggagtggggaacagagactttgtggaaggagtctcaggtggagcatgggtcgatttggtgctagaacatggaggatgtgtcacaaccatggcccagggaaaaccaaccttggattttgaactgatcaagacaacagccaaggaagtggctctgttaagaacctattgcattgaagcctcgatatcaaacataaccacggcaacaagatgtccaacgcaaggagaaccttatctcaaagaggaacaagatcaacagtacatttgccggagagatgtggtagacagagggtggggcaatggctgtggcttgtttgggaaaggaggagttgtgacatgtgcgaagttttcatgctcggggaagataacaggcaatttggtccaaattgagaaccttgaatacacagtagttgtaacagtccacaatggagacacccatgcagtaggaaatgacatacccaaccatggagtgacagccacgataacccccaggtcaccatcggtagaagttaaattaccggattatggagaattaacactcgattgtgaacccaggtccggaattgattttaatgagatgattctgatgaaaatgaaaaagaaaacgtggcttgtgcacaagcaatggtttttggatctacctctaccatgggcagcaggagcagacacatcagaagttcattggaattacaaagagagaatggtgacattcaaggttcctcatgccaagagacaggatgtgatagtgctaggatctcaggaaggagccatgcattctgccctcaccggagctacagaagtggattccggtgatggaaaccacatgtttgcaggacatctgaaatgcaaagttcgcatggagaaattgagaattaagggaatgtcatacacgatgtgctcaggaaagttctcaattgacaaagagatggcagaaacacagcatgggacaacagtggtaaaagtcaagtatgagggtgctggagctccatgtaaagttcccatagagataagagatgtgaacaaggaaaaagtggtagggcgcatcatctcatctaccccttttgctgagtataccaacagtgtaaccaacatagaattagaacccccctttggggacagctacatagtaataggtgttggagacagtgcattaacactccattggttcaggaaagggagttccattggcaagatgcttgagtccacatacagaggcgcaaagcgaatggccattctaggtgaaacagcctgggattttggttctgttggtggactgctcacatcattgggaaaggctgtacaccaggtttttggtagtgtgtatacaactatgtttggaggagtctcatggatggttagaatcctaattgggttcttagtgttgtggattggcacgaattcgagaaacacctcaatggcaatgacgtgcatagctgttggaggaatcactctgtttctgggtttcacagttcacgcagacacgggttgtgcggtgtcatggagtgggaaagaattgaaatgtggaagcggaatctttgtaattgacaacgtgcacacttggacagaacagtacaaatttcaaccagagtctccagcgagactagcgtccgcaatattgaatgcccacaaagatggggtctgtggaattagatcaaccacgaggctggaaaacatcatgtggaagcaaataaccaacgagttgaactatgttctctgggaaggaggacatgacctcactgtagtggctggggatgtgaaaggggtgctgtccaaaggcaagagagcactcgcacccccagtgaatgatctgaaatattcatggaagacatggggaaaagcaaagatctttactccagaagcaaaaaatagcacatttctaatagacggaccagacacctccgaatgccccaatgaacgaagagcatggaattttcttgaggtagaagactatggatttggcatgtttacgaccaacatatggatgaaatttcgagaaggaagttcagaagtgtgtgaccacaggttgatgtcggcggcaatcaaagaccagaaagctgtgcatgctgacatgggctattggatagagagctcaaaaaaccagacctggcagatagagaaagcatctctcattgaagtgaaaacatgtctgtggcccaagacccacacattgtggagcaatggagtgctagagagccagatgctcatcccaaaagcatatgcaggccctttttcacagcacaattaccgccagggctatgccacgcagaccgtgggcccatggcacttgggcaaattggagatagactttggagaatgccccggaacaacagtcactattcaagaggattgtgaccatagaggcccatctttgaggaccactactgcatctggaaaattggtcacgcagtggtgctgccgctcctgcacgatgcctcccttaaggtttttgggagaggatggatgctggtatgggatggaaattaggcccttgagtgaaaaagaagagaacatggtcaaatcacaggtatcggccggacagggtacatcagaaactttttctatggggctgttatgcctgactttgtttgtggaagaatgcttgaggagaagagtcaccaggaaacacatgatattggttgtggtgaccaccctttgtgccatcatcctaggaggtctcacatggatggacttactacgagctcttatcatgttaggggacaccatgtctggtagaatgggaggacagattcacttagccatcatggcagtgttcaagatgtcaccaggatacgtgctgggtatatttttaaggaaactcacttcaagagagacagcactaatggtgataggaatggccatgacaacggtgctttcaattccacatgaccttatggaattcattgatggaatatcactggggttaatcttattaaaaatggtaacacattttgacaacactcaagtgggaaccttagctctttccttgactttcataagatcaacaatgccattggtcatggcttggaggaccataatggctgtgttgtttgtggtcacactcattcctttatgcaggacaagctgtcttcaaaagcagtcacattgggtagaaataacagcactcatcctgggagcccaggctctgccagtgtacctaatgactctcatgaaaggagcttcaaagagatcttggccccttaacgagggtataatggctgtgggtttggtcagtctcttgggaagcgccctcctaaagaatgatgtccctttagctggcccaatggtggcaggaggcttacttctggcagcctatgtgatgagtggtagctcagcagacctgtcactagagaaggccgccaatgtgcagtgggatgagatggcagacataacaggctcaagcccaatcatagaagtgaagcaggatgaagatggctctttctccatacgggacatcgaggaaaccaatatgataaccctcttagtgaaactggcactgataacagtgtcaggtctctaccccttggcaattccagtcacaatgaccctatggtacatgtggcaagtgaaaacacaaagatcaggagccctgtgggacgtcccctcacctgctgccgctcagaaagccacactgactgaaggagtgtacaggatcatgcaaagagggttgtttgggaaaactcaggttggagtagggatacacatggaaggtgtatttcacacaatgtggcatgtaacaagaggatcagtgatctgccatgagactgggagactggagccatcttgggctgacgtcaggaacgacatgatatcatacggtgggggatggaggctcggagacaaatgggacaaagaagaagatgttcaggttctagctatagaaccaggaaaaaatccgaaacatgtccaaacgaagcccggccttttcaaaaccctaactggagaaattggagcagtgacattggacttcaaacccggaacatccggttctcccatcattaacaggaaaggaaaagttatcggactctacggaaatggagtagtcactaaatcaggtgattacgtcagtgctataacgcaagccgaaagaactggtgagccagattatgaagtggatgaggacatttttcgaaagaaaagattaactataatggacttacaccccggagccggaaagacaaaaagaattctcccatcaatagtcagagaagccttaaaaaggaggctgcgaaccttgattttggctcccacgagagtggtggcggccgagatggaagaggccctacgtggactgccaatccgttatcagaccccagctgtgaaatcagaacacacaggaagagagatcgtagacctcatgtgtcatgcaaccttcacaacaagacttttatcatcaaccagggttccaaattacaacctcatagtgatggatgaagcacatttcacagacccttctagtgtcgcggctagaggatacatctcaaccagggtggaaatgggagaggcagcagccatctttatgactgcaacccctcctggagcgacagatcccttcccccagagcaacagcccaatagaagacatcgagagagaaattccagaaaggtcatggaacacagggttcgactggataaccgactaccaagggaaaactgtgtggtttgttcccagcataaaagctggaaatgacattgcaaattgcttgagaaagtcgggaaagaaggtgatccaattgagtagaaaaacctttgacacagagtatccaaaaacgaaacttacggactgggattttgtggttaccacagacatatcagaaatgggggccaattttagagctgggagagtgatagaccccaggagatgcctcaagccagttatctcaactgacgggccagagagagttattttggcaggtcccattccagtgactccagcaagcgctgctcagagaagagggcgaataggtaggaacccagcacaagaagatgaccaatatgtcttctccggagacccactaaaaaatgatgaagatcatgcccactggacagaagcaaagatgctgcttgataatatctacaccccggaagggatcattccaacattgtttggtccggaaagagaaaaaaatcaagccattgatggagagttccgcctcagaggggaacaaaggaagacttttgtagaattaatgaggagaggagaccttccggtgtggctgagctacaaggtagcttctgctggtatctcttacaaagaccgggaatggtgcttcacaggggaaaggaataaccaaattctagaagaaaacatggaggttgaaatttggactagagagggagagaagaaaaaactcaggccaaaatggttagatgcacgtgtttacgctgaccccatggctttgaaggatttcaaggagtttgccagtggaagaaagagcataaccctcgacatcctaacagagattgccagtttgccaacttacctttcctctagggctaagctcgcccttgacaacatagtcatgctccacacaacagaaagaggagggaaggcctaccaacatgccctgaacgaactcccggagtcactagaaacactcatgcttgtagctttactgggtgctatgacagcaggcatcttcttgtttttcatgcaaggaaaaggaatagggaaactgtcaatgggtttgatagccattgcggtagctagtggcttgctctgggtagcagaaatccagccccagtggatagcggcctcaatcatactagagttctttctcatggtgttgttgataccagaaccagaaaaacaaaggaccccacaagacaatcaattgatctacgtcatattgaccattctcaccattattggtctcatagcagccaacgagatggggctgattgaaaaaacaaaaacggattttgggttttaccaggtaaaaacagaaaccaccatcctcgatgtggatttgagaccagcctcagcatggacgctctatgcagtagccaccactattctgactcccatgctgagacacaccatagaaaacacgtctgcaaacctatctctagcggccattgctaaccaagcagctgtcctaatggggcttggaaaaggatggccgctccacagaatggacctcggtgtgccgctgttggcaatgggatgctattctcaagtgaacccaacgaccttgatagcatccttagtcatgcttttagtccattacgcaataataggtccaggactgcaggcaaaagccacaagagaggctcagaaaaggacagcagctgggatcatgaagaaccccactgtggacgggataacagtaatagatctagaaccaatatcctatgacccaaaatttgaaaagcaattagggcaagtcatgctactagtcttgtgtgctggacagctactcttgatgagaacaacatgggctttctgtgaagtcttgactttggccacaggaccagtcttgaccctgtgggagggcaacccgggaaggttttggaacacgactatagccgtgtccactgccaatattttcaggggaagctacttggcgggagctggactggccttttcgctcataaagaatgcacaaacccccaggaggggaactgggaccacaggagagacactgggagagaagtggaagagacagctaaactcactagataggaaggagtttgaagagtacaaaagaagtggaatactagaagtggacaggactgaagccaagtctgccttgaaagatggatctaaaatcaagcatgcagtgtccagagggtccagcaagattagatggattgttgaaagagggatggtaaaaccaaaagggaaagttgtggatcttggttgcgggagaggaggatggtcgtactacatggcgacactcaagaacgtgaccgaggtgaaagggtacacaaaaggaggtccaggacatgaagaaccgattcccatggctacctatggctggaacttggtcaaactccattcaggggttgacgtgttctacaaacccactgagcaagtggataccctgctctgtgatattggggagtcatcttctaatccgacgatagaggaaggaagaacattaagagttttgaagatggtggaaccatggctctcttcaaaacctgaattctgcatcaaagtccttaatccctacatgccaacagtcatagaagagctggagaaactgcagagaaaacatggtggaagtcttgtcagatgcccgctatctaggaattccactcacgagatgtattgggtgtcaggtgtgtcgggaaacatcgtgagctctgtaaacacaacatcaaagatgttgttgaacagatttaccacaaggcatagaaaacccacttatgagaaggacgtagaccttggagcaggaacgagaagtgtctccactgaaacagaaaaaccggacatgacaatcattgggagaaggcttcagcgactgcaagaagagcacaaagaaacttggcactatgatcaggaaaacccatacagaacctgggcgtatcatggaagctatgaagctccttcgacaggctcagcatcctccatggtgaacggggtagtaaaattgctgacaaaaccctgggacgtgattccaatggtgacccagttggctatgacagacacaaccccttttgggcaacagagagtgtttaaagagaaggtggacaccagaacaccacaaccaaaacccggcacacgaatggttatgaccacgacagccaactggctgtgggctctcctcgggaagaagaaaaatcccagactgtgcacaagggaagagttcatctcaaaagttaggtcaaacgcagccataggcgcagtctttcaggaagaacagggatggacatcagccagtgaagctgtgaatgacagccgattttgggaactggttgacaaagaaagggctctgcaccaggaagggaaatgtgaatcgtgtgtctacaacatgatgggaaaacgtgagaaaaagttaggagagtttggtagagccaagggaagccgagcaatctggtacatgtggctgggagcgcggtttctggaatttgaagccctgggttttttgaatgaagatcactggtttggcagagaaaactcatggagtggagtggaaggggaaggtctgcatagattgggatatatcctggaggacatagacaagaaggatggagacctgatatatgctgatgacacagctggttgggacacaagaatcactgaagatgaccttctaaatgaagaactgatcacggaacagatggcccctcaccataagatcctagccaaagccattttcaaactaacttatcaaaacaaagtggtgaaagtcctcagacccacaccgaaaggagcggtgatggatatcatatccaggaaagaccaaagaggtagtggacaggttggaacatatggtttgaacacattcaccaacatggaagtacaactcatccgccaaatggaagctgaaggagtcatcacacaagatgacatgcataacccaaaagggttgaaagaaagagttgagaaatggctgaaagagtgtggtgtcgacaggttaaagaggatggcaatcagtggagacgattgtgtggtgaagcctctggatgagaggttcagcacttccctcctctttttgaacgacatgggaaaggtgaggaaagacattccgcagtgggaaccatctaagggatggaaaaactggcaagaggttcctttttgctcccaccactttcacaagatcttcatgaaggatggccgctcactagttgttccatgtagaaaccaggatgaactgatagggagagccagaatctcgcaaggggctggatggagtttaagagaaacagcctgcctgggcaaagcttacgcccagatgtggtcgctcatgtactttcatagaagggacctgcgtttagcctccatggcgatatgctcagcagttccaacagaatggtttccaacaagcagaacaacatggtcaatccacgcccatcatcagtggatgaccactgaagatatgctcaaagtgtggaacagagtgtggatagaagacaaccctaatatgactgacaagactccagttcattcgtgggaagacataccttacctaggaaaaagagaagatttgtggtgtggatccttgattggactttcttccagggccacctgggcgaagaacattcacacagccataacccaggtcaggaacctgatcgggaaagaggagtatgtggattacatgccagtcatgaaaagatacagcgctcctttcgagagtgaaggagttctgtaa

SEQ ID NO: 7801 - RNA, 9867 nt, synthetic construct
  misc_feature 1..9867: note = derived and/or modified CDS sequence (wt) from DENV-4__FJ024424__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctcatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaattgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacaaccacgataactcccaggtcaccatcggtggaagtcaaattgccggactatggagaactaacactcgattgtgaacccaggtctggaattgactttaatgagatgatcctaatgaaaatgaaaaagaaaacatggctcgtgcataagcaatggtttttagatttgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaagctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcggacatgggttgtgtggtgtcatggagtgggaaagagttgaagtgtgggagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacttttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcaaatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcactattcaggaggattgtgaccatagaggcccatctctgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaaatcacaagtggcggccggacagggcacatcagaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccagggtacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctgggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctctaccctttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagctgaaagaattggagagccagattatgaggtggatgaggatatttttcgaaagaaaagattaactataatggacttacaccccggagctggaaagacaaaaagaattcttccatcaatagtgagagaagccttaaaaaggaggctgcgaactttgattctggctcccacgagagtggtggcggccgagatggaagaggccctacgtggactgccaatccgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtcattttagcaggtcctattccagtaactccagcaagcgctgctcagagaagagggcgaataggaaggaacccaacacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattctagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagcttgccaacttacctttcctctagggccaagctcgcccttgacaacatagtcatgctccacacaacagaaagaggagggagggcctatcaacacgccttgaacgaacttccggagtcactggaaacactcatgcttgtagccttactaggtgctatgacagcaggcatcttcctgttttttatgcaagggaaaggaatagggaaattgtcaatgggtttgataaccattgcggtggctagtggcttgctctgggtagcagaaattcaaccccagtggatagcggcttcaatcatactggagttttttctcatggtactgttgataccagaaccagaaaaacaaaggactccacaagacaatcaattgatctacgtcatattgaccattctcaccattattggtctaatagcagccaacgagatggggctgatagaaaaaacaaaaacggattttgggttttaccaagtaaaaacagaaaccaccatcctcgatgtggacttgagaccagcttcagcatggacgctctatgcggtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccgacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaaacaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgctaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatctcggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatatgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgggcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctctcaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccaatggatgaccactgaagacatgctcaaagtgtggaacagagtgtggatagaagacaaccccaatatgattgacaagaccccagtccattcgtgggaagatataccttacctagggaaaagggaggatttgtggtgtggatccctaattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 7802 - RNA, 9867 nt, synthetic construct
  misc_feature 1..9867: note = derived and/or modified CDS sequence (wt) from DENV-4__EU854295__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaaacatgctcagagagtagagagctggatactcagaaacccaggatttgcgctcttggcaggatttatggcttatatgattgggcaaacaggaatccagcgaactgttttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaagctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaattactctgtttttgggcttcacggttcaagcggacatggggtgtgtggtgtcatggagtgggagagagttgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgacctgaaatattcatggaagacatggggaaaagcaaaaatcttcaccccagaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacagattaatgtcagctgcaattaaagatcaaaaagctgtgcatgctgacatgggttattggatagagagctcaaaaaaccagacctggcagatagagaaagcatctcttattgaagtgaaaacatgtctgtggcccaagacccacacactatggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaaatcacaggtggcggccggaccgggcacatcagaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccagggtacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaaaaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctctaccctttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgctataacgcaagccgaaagaattggagagccagattatgaggtggatgaggatatttttcgaaagaaaagattaactataatggacttacaccccggagctggaaagacaaaaagaattcttccatcaatagtgagagaagccttaaaaaggaggctgcgaactttgattctggctcccacgagagtggtggcggccgagatggaagaggccctacgtggactgccaatccgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagcttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcttcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttatcaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaaacaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaaaccaaaagggaaagttgtagatcttggctgtgggagaggaggatggtcttattacatggcgacactcaagaacgtgactgaagtgaaagggtatacaaaaggaggtccaggacatgaagaaccgattcccatggctacctatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagagacatggcattatgatcaggaaaacccatacagaacctgggcgtaccatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgagtggttatgaccacgacagctaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagctattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacgcaagatgacatgcagaacccaaaagggttgaaagaaagagttgagaaatggctgagagagtgtggtgtcgacaggttaaagagaatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctctcaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccaatggatgaccactgaagacatgctcaaagtgtggaacagagtgtggatagaagacaaccccaatatgattgacaagaccccagtccattcgtgggaagatataccctacctagggaaaagagaggatttgtggtgtggatccctgattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 7803 - RNA, 9867 nt, synthetic construct
  misc_feature 1..9867: note = derived and/or modified CDS sequence (wt) from DENV-4__EU854296__SS-prME
  source 1..9867: mol_type = other RNA
tcaacaataacattgttgtgcttgattcccactgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctattggtcaataccgaacctgaagacattgattgctggtgcaacctcacgtctacctgggtcatgtatggaacatgcacccagagtggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcttggcaggatttatggcttacatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgttagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgactgtgaacccaggtctggaattgactttaatgagatgatcctaatgaaaatgaaaaagaaaacatggctcgtgcataagcaatggtttttggatttgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggtttaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacctgcatagctgttggaggaatcactctgtttttgggctttacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgcgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggtatgtttacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacttggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccctagctctttccttgactttcataagatcaacaatgtcattggtcatggcttggaggaccattatggctgtgttgtttgtggtcacactcattcccttgtgcaggacaagctgtcttcagaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggctattcgggaaaactcaggttggagtagggatacacatggaaggtgtgtttcacacaatgtggcatgttacaagaggatcagtgatctgccacgagactgggagattggagccatcttgggctgacgtcaggaatgacatgatatcatacggtggaggatggaggcttggagacaaatgggacaaagaagaagacgttcaggtcctcgctatagaaccaggaaaaaatcccaaacatgtccaaacgaaacctggccttttcaagaccttaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgatactggctcccacgagagtggtggcggccgagatggaagaggccctacgtggactgccaatccgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgactagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgacacagaatatccaaaaacgaaactcacggactgggactttgtggtcactacagatatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatctcttacaaagatcgggaatggtgcttcactggggaaagaaataaccaaattttggaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctaccaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccatcattggtctaatagcagccaacgagatggggctgatagaaaaaacaaaaacggattttgggttttaccaggcaaaaacagaaaccaccatcctcgatgtggacttgagaccagcttcagcatggacgctctatgcggtagccaccacaattctgactcccatgctgagacacaccatagaaaacacgtcggccaacctatctctagcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggctcagaaaaggacagctgctggaatcatgaaaaatccaacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttaaccttgtgggagggcaacccgggaaggttttggaacacgaccatagccgtatccaccgccaacattttcaggggaagttacttggcgggagctggattggctttttcactcataaagaatgcacaaacccctaggaggggaactgggaccataggagagacactgggagagaagtggaagagacagctaaactcattagacaggaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacagacccacagagcaagtggacaccctgctctgtgatattggggagtcatcttctaatccaacaatagaggaaggaagaacattaagagttctgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactctacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaggagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaaattaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggctgaaagaaagagttgagaaatggctgagagagtgtggtgtcgacaggttaaagaggatggcaatcagtggagacgactgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacgacatggtcaatccatgctcatcaccaatggatgaccactgaagacatgctcaaagtgtggaacagagtgtggatagaagacaaccccaatatgattgacaagactccagtccattcgtgggaagatataccttacctagggaaaagagaggatttgtggtgtggatccctgattgggctttcttccagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 7804 - RNA, 9867 nt, synthetic construct
  misc_feature 1..9867: note = derived and/or modified CDS sequence (wt) from DENV-4__GQ199878__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacagttcaagcggacatgggttgtgtggtgtcatggagtgggagagagttgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaaatcacaggtggcggccggacagggcacatcagaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggatatttttcgaaagaaaagattaactataatggacttacaccccggagctggaaagacaaaaagaattcttccatcaatagtgagagaagccttaaaaaggaggctgcgaactttgattctggctcccacgagagtggtggcggccgagatggaagaggccctacgtggactgccaatccgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagcttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggcatcttcctgtttttcatgcaagggaaaggaatagggaaattgtcaatgggtttgataaccattgcggtggctagtggcttgctctgggtagcagaaattcaacctcagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaaacaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccaatggatgaccactgaagacatgctcaaagtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcagaaacctgatcggaaaagaggaatacgtggattacatgccagtaatgaaaagatacagtgctccttcagagagtgaaggagttctgtaa

SEQ ID NO: 7805 - RNA, 9867 nt, synthetic construct
  misc_feature 1..9867: note = derived and/or modified CDS sequence (wt) from DENV-4__GQ199879__SS-prME
  source 1..9867: mol_type = other RNA
tcaacgataacattactgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgttacgtataaatgtcccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggggagccctatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatctggtccaaattgagaaccttgagtacacagtggttgtaacagtccacaatggagacacccatgcagtaggaaatgacacatccaatcatggagttacagctacgataactcccaggtcaccatcggtggaagtcaaattgccggactatggagaactaacactcgactgtgaacccaggtctggaattgactttaatgagatgattctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggaaaaattgagaatcaagggaatgtcatacacgatgtgttcaggaaagttctcaatcgacaaagagatggcagaaacacagcatgggacaacagtggtgaaagtcaagtatgaaggtgctggagctccgtgtaaagtccccatagagataagagatgtaaacaaggaaaaagtggttgggcgcgtcatctcatccacccctttggctgagaacaccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatggttagaatcctaattgggttcttagtgttgtggattggcacaaactcaaggaatacttcaatggctatgacgtgcatagctgttggaggtatcactctgtttctgggcttcacagttcaagcggacatgggttgtgtggtatcatggagtgggagagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgtcctctgggaaggaggacacgatctcactgtagtggctggggatgtgaagggggtgttgactaaaggcaagagagcactcacacccccagtgagtgatctgaaatattcatggaagacatggggaaaagcaaaaatcttcaccccagaagcaagaaacagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagccgcaattaaagatcagaaagctgtgcatgctgacatgggttattggatagagagctcaaaaaaccagacctggcagatagagaaagcatctcttattgaggtgaaaacatgtctgtggcccaagacccacacactgtggagcaatggagtgctggaaagccagatgctcattccaaaatcatatgcgggccctttttcacagcacaattaccgccagggctatgccacgcaaaccgtgggtccatggcacttaggcaaattagagatagacttcggagaatgccccggaacaacagtcacaattcaggaggattgtgaccatagaggcccatctttgaggaccaccactgcatctggaaaactagtcacgcagtggtgctgccgctcctgcacgatgcctcccttaaggttcttgggagaagatgggtgctggtatggaatggagattaggcctttgaatgaaaaagaagagaacatggtcaaatcacaggtgacggccggacagggcacatcagaaactttttctatgggactgttgtgcctgaccttgtttgtggaagaatgcttgaggagaagagttactaggaaacacatgatattagttgtggtgatcactctttgtgctatcatcctgggaggcctcacatggatggacttactacgagccctcatcatgttaggggacactatgtctggtagaataggaggacagatccacctagccatcatggcagtgttcaagatgtcaccaggatacgtactgggtgtgtttttaaggaaactcacttcaagagagacagcactaatggtaataggaatggccatgacaacggtactttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagcctcttaggaagcgctcttttaaaaaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaagatgaagatggctctttctccatacgggacgtcgaggaaaccaatatgataacccttttggtgaaactggcactgataacagtatcaggtctctaccccctggcaattccagtcacaatgaccttgtggtacatgtggcaagtgaaaacacaaagatcaggagccctgtgggacgtcccctcacccgctgccactcaaaaagctgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattggatttcaaacccggcacgtctggttctcccatcatcaacaggaaaggaaaagtcatcggactctatggaaatggagtggttaccaaatcaggcgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctccaacgagagtggtggcggccgagatggaagaggccctacgtggactgccaatccgttatcagactccagctgtgaaatcagaacacacaggaagagagattgtagacctcatgtgtcatgcaaccttcacaacaagacttttgtcatcaaccagggttccgaattacaaccttatagtgatggatgaagcacatttcaccgatccttctagtgttgcggctaggggatacatttcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagctgggagagtgatagaccctagaagatgcctcaagccagttatcctaacagatgggccagagagagtcattttagcaggtcctattccagtgactccagcaagtgctgctcagagaagagggcgaataggaaggaacccagcacaagaagacgaccaatacgttttctccggagatccactaaaaaatgatgaagatcatgcccactggacagaagcaaagatgctgcttgacaatatctacaccccagaagggatcattccaacattgtttggtccggaaagggaaaaaacccaagctattgatggagagtttcgccttagaggggaacaaaggaagacttttgtggaattaatgaggagaggagaccttccggtgtggctgagctacaaggtagcttctgctggcatttcttataaagatcgggaatggtgcttcacaggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacgctcatgcttgtagctttactaggtgctatgacagcaggtatcttcctgtttttcatgcaagggaaaggaatagggaaattgtcaatgggtttgatagccattgcggtggctagtggcttgctctgggtagcagaaattcaaccccagtggatagcggcctcaatcatactagagttttttctcatggtactgttgataccagaaccagaaaaacaaaggactccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaatcctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttggtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgaggacaacatgggctttctgtgaagtcttgactttggccacaggaccaatcttgaccttgtgggagggtaacccgggaaggttttggaacacgaccatagccgtatccaccgccaacattttcaggggaagttacttggcgggggctggactggctttttcactcataaagaatgcacaaacccctaggaggggaactgggaccacaggagagacactgggagagaagtggaagagacagctaaactcattagacagaaaagagtttgaagagtacaaaagaagtggaatactagaagtggacaggactgaagccaagtcagccctgaaagatggatctaaaaccaagcatgcagtatctagagggtccagtaagatcagatggattgttgagagagggatggtaaagccaaaagggaaagttgtagatcttggctgtgggagaggaggttggtcttattacatggcgacactcaagaacgtgactgaagtgaaagggtatacaaaaggaggtccaggacatgaagagccgattcccatggctacttatggctggaatttggtcaaactccattcaggggttgacgtgttctacaaacccacagaacaagtggacaccctgctctgtgatattggggagtcatcttctaatccaacaatagaggaaggaagaacattaagagttttgaagatggtggagccatggctctcttcaaaacctgaattctgtatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacggaaaaaccagacatgacaatcattgggagaaggcttcagcgattgcaagaagagcacaaagaaacctggcattatgatcaggaaaacccatacagaacttgggcgtatcatggaagctatgaagctccttcgacaggctctgcatcctccatggtgaacggggtagtgaaactgctaacaaaaccctgggatgtgattccaatggtgactcagttagccatgacagatacaaccccttttgggcaacaaagagtgttcaaagagaaggtggataccagaacaccacaaccaaaacccggcacacgaatgattatgaccacgacagccaattggctgtgggctctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggtcgataaagaaagggccctacaccaggaagggaaatgtgaatcgtgtgtctacaacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggttatatcctggaggagatagacaagaaggatggagacctaatgtatgctgatgacacagcaggctgggacacaagaattactgaggatgaccttcaaaatgaagaactgatcacggaacagatggctccccaccacaagatcctagccaaagctattttcaaactaacctatcaaaataaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaagatggccgctcactagtcgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccaatccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 7806 - RNA, 9867 nt, synthetic construct
  misc_feature 1..9867: note = derived and/or modified CDS sequence (wt) from DENV-4__GQ199880__SS-prME
  source 1..9867: mol_type = other RNA
tcaacgataacattactgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgttacgtataaatgtcccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggggagccctatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatctggtccaaattgagaaccttgagtacacagtggttgtaacagtccacaatggagacacccatgcagtaggaaatgacacatccaatcatggagttacagctacgataactcccaggtcaccatcggtggaagtcaaattgccggactatggagaactaacactcgactgtgaacccaggtctggaattgactttaatgagatgattctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggaaaaattgagaatcaagggaatgtcatacacgatgtgttcaggaaagttctcaatcgacaaagagatggcagaaacacagcatgggacaacagtggtgaaagtcaagtatgaaggtgctggagctccgtgtaaagtccccatagagataagagatgtaaacaaggaaaaagtggttgggcgcgtcatctcatccacccctttggctgagaacaccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattttaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacaaactcaaggaatacttcaatggctatgacgtgcatagctgttggaggtatcactctgtttctgggcttcacagttcaagcggacatgggttgtgtggtatcatggagtgggagagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgtcctctgggaaggaggacacgatctcactgtagtggctggggatgtgaagggggtgttgactaaaggcaagagagcactcacacccccagtgagtgatctgaaatattcatggaagacatggggaaaagcaaaaatcttcaccccagaagcaagaaacagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagccgcaattaaagatcagaaagctgtgcatgctgacatgggttattggatagagagctcaaaaaaccagacctggcagatagagaaagcatctcttattgaggtgaaaacatgtctgtggcccaagacccacacactgtggagcaatggagtgctggaaagccagatgctcattccaaaatcatatgcgggccctttttcacagcacaattaccgccagggctatgccacgcaaaccgtgggtccatggcacttaggcaaattagagatagacttcggagaatgccctggaacaacagtcacaattcaggaggattgtgaccatagaggcccatctttgaggaccaccactgcatctggaaaactagtcacgcagtggtgctgccgctcctgcacgatgcctcccttaaggttcttgggagaagatgggtgctggtatggaatggagattaggcctttgaatgaaaaagaagagaacatggtcaaatcacaggtgacggccggacagggcacatcagaaactttttctatgggactgttgtgcctgaccttgtttgtggaagaatgcttgaggagaagagttactaggaaacacatgatattagttgtggtgatcactctttgtgctatcatcctgggaggcctcacatggatggacttactacgagccctcatcatgttaggggacactatgtctggtagaataggaggacagatccacctagccatcatggcagtgttcaagatgtcaccaggatacgtactgggtgtgtttttaaggaaactcacttcaagagagacagcactaatggtaataggaatggccatgacaacggtactttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagcctcttaggaagcgctcttttaaaaaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaagatgaagatggctctttctccatacgggacgtcgaggaaaccaatatgataacccttttggtgaaactggcactgataacagtatcaggtctctaccccctggcaattccagtcacaatgaccttgtggtacatgtggcaagtgaaaacacaaagatcaggagccctgtgggacgttccttcacccgctgccactcaaaaagctgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattggatttcaaacctggcacgtctggttctcccatcatcaacaggaaaggaaaagtcatcggactctatggaaatggagtggttaccaaatcaggcgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctccaacgagagtggtggcggccgagatggaagaggccctacgtggactgccaatccgttatcagactccagctgtgaaatcagaacacacaggaagagagattgtagacctcatgtgtcatgcaaccttcacaacaagacttttgtcatcaaccagggttccgaactacaaccttatagtgatggatgaagcacatttcaccgatccttctagtgttgcggctaggggatacatttcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagctgggagagtgatagaccctagaagatgcctcaagccagttatcctaacagatgggccagagagagtcattttagcaggtcctattccagtgactccagcaagtgctgctcagagaagagggcgaataggaaggaacccagcacaagaagacgaccaatacgttttctccggagatccactaaaaaatgatgaagatcatgcccactggacagaagcaaagatgctgcttgacaatatctacaccccagaagggatcattccaacattgtttggtccggaaagggaaaaaacccaagctattgatggagagtttcgccttagaggggaacaaaggaagacttttgtggaattaatgaggagaggagaccttccggtgtggctgagctacaaggtagcttctgctggcatttcttataaagatcgggaatggtgcttcacaggggaaagaaataaccaaattttagaagaaaacatggaggttgaaatttggactagagagggagaaaagaaaaaactgaggccaagatggttagatgcacgtgtatacgctgaccccatggctttgaaggacttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacgctcatgcttgtagctttactaggtgctatgacagcaggtatcttcctgtttttcatgcaagggaaaggaatagggaaattgtcaatgggtttgatagccattgcggtggctagtggcttgctctgggtagcagaaattcaaccccagtggatagcggcctcaatcatactagagttttttctcatggtactgttgataccagaaccagaaaaacaaaggactccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaatcctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttggtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgaggacaacatgggctttctgtgaagtcttgactttggccacaggaccaatcttgaccttgtgggagggtaacccgggaaggttttggaacacgaccatagccgtatccaccgccaacattttcaggggaagttacttggcgggggctggactggctttttcactcataaagaatgcacaaacccctaggaggggaactgggaccacaggagagacactgggagagaagtggaagagacaactaaactcattagacagaaaagagtttgaagagtacaaaagaagtggaatactagaagtggacaggactgaagccaagtcagccctgaaagatggatctaaaaccaagcatgcagtatctagagggtccagtaagatcagatggattgttgagagagggatggtaaagccaaaagggaaagttgtagatcttggctgtgggagaggaggttggtcttattacatggcgacactcaagaacgtgactgaagtgaaagggtatacaaaaggaggtccaggacatgaagagccgattcccatggctacttatggctggaatttggtcaaactccattcaggggttgacgtgttctacaaacccacagaacaagtggacaccctgctctgtgatattggggagtcatcttctaatccaacaatagaggaaggaagaacattaagagttttgaagatggtggagccatggctctcttcaaaacctgaattctgtatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcactacaaggcataggaaacccacttatgagaaggacgtagatcttggggcaggaacgagaagtgtctctactgaaacggaaaaaccagacatgacaatcattgggagaaggcttcagcgattgcaagaagagcacaaagaaacctggcattatgatcaggaaaacccatacagaacttgggcgtatcatggaagctatgaagctccttcgacaggctctgcatcctccatggtgaacggggtagtgaaactgctaacaaaaccctgggatgtgattccaatggtgactcagttagccatgacagatacaaccccttttgggcaacaaagagtgttcaaagagaaggtggataccagaacaccacaaccaaaacccggcacacgaatgattatgaccacgacagccaattggctgtgggctctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggtcgataaagaaagggccctacaccaggaagggaaatgtgaatcgtgtgtctacaacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggttatatcctggaggagatagacaagaaggatggagacctaatgtatgctgatgacacagcaggctgggacacaagaattactgaggatgaccttcaaaatgaagaactgatcacggaacagatggctccccaccacaagatcctagccaaagctattttcaaactaacctatcaaaataaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaagatggccgctcactagtcgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccaatccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 7807 - RNA, 9867 nt, synthetic construct
  misc_feature 1..9867: note = derived and/or modified CDS sequence (wt) from DENV-4__GQ252675__SS-prME
  source 1..9867: mol_type = other RNA
tcaacgataacattactgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgttacgtataaatgtcccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggggagccctatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatctggttcaaattgagaaccttgagtacacagtggttgtaacagtccacaatggagacacccatgcagtaggaaatgacacatccaatcatggagttacagctacgataactcccaggtcaccatcggtggaagtcaaattgccggactatggagaactaacactcgactgtgaacccaggtctggaattgactttaatgagatgattctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaaatccgtatggaaaaattgagaatcaagggaatgtcatacacgatgtgttcaggaaagttctcaatcgacaaagagatggcagaaacacagcatgggacaacagtggtgaaagtcaagtatgaaggtgctggagctccgtgtaaagtccccatagagataagagatgtaaacaaggaaaaagtggttgggcgcgtcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattaggatcctaattgggttcttagtgttgtggattggcacaaactcaaggaatacttcaatggctatgacgtgcatagctgttggaggtatcactctgtttctgggcttcacagttcaagcggacatgggttgtgtggtatcatggagtgggagagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgtcctctgggaaggaggacacgatctcactgtagtggctggggatgtgaagggggtgttgactaaaggcaagagagcactcacacccccagtgagtgatctgaaatattcatggaagacatggggaaaagcaaaaatcttcaccccagaagcaagaaacagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaggtgaaaacatgtctgtggcccaagacccacacactgtggagcaatggagtgctggaaagccagatgctcattccaaaatcatatgcgggccctttttcacagcacaattaccgccagggctatgccacgcaaaccgtgggtccatggcacttaggcaaattagagatagacttcggagaatgccccggaacaacagtcacaattcaggaggattgtgaccatagaggcccatctttgaggaccaccactgcatctggaaaactagtcacgcagtggtgctgccgctcctgcacgatgcctcccttaaggttcttgggagaagatgggtgctggtatggaatggagattaggcctttgaatgaaaaagaagagaacatggtcaaatcacaggtgacggccggacagggcacatcagaaactttttctatgggactgttgtgcctgaccttgtttgtggaagaatgcttgaggagaagagttactaggaaacacatgatgttagttgtggtgatcactctttgtgctatcatcctgggaggcctcacatggatggacttactacgagccctcatcatgttaggggacactatgtctggtagaataggaggacagatccacctagccatcatggcagtgttcaagatgtcaccaggatacgtactgggtgtgtttttaaggaaactcacttcaagagagacagcactaatggtaataggaatggccatgacaacggtactttcaattccacatgaccttatggaactcattgatggaatatcattgggactaattttgctaaaaacagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagcctcttaggaagcgctcttttaaaaaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaagatgaagatggctctttctccatacgggacgtcgaggaaaccaatatgataacccttttggtgaaactggcactgataacagtatcaggtctctaccccctggcaattccagtcacaatgaccttgtggtacatgtggcaagtgaaaacacaaagatcaggagccctgtgggacgtcccctcacccgctgccactcaaaaagctgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattggatttcaaacccggcacgtctggttctcccatcatcaacaagaaaggaaaagtcatcggactctatggaaatggagtggttaccaaatcaggcgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctccaacgagagtggtggcggccgagatggaagaggccctacgtggactgccaatccgttatcagactccagctgtgaaatcagaacacacaggaagagagattgtagacctcatgtgtcatgcaaccttcacaacaagacttttgtcatcaaccagggttccgaattacaaccttatagtgatggatgaagcacatttcaccgatccttctagtgttgcggctaggggatacatttcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagctgggagagtgatagaccctagaagatgcctcaagccagttatcctaacagatgggccagagagagtcattttagcaggtcctattccagtgactccagcaagtgctgctcagagaagagggcgaataggaaggaacccagcgcaagaagacgaccaatacgttttctccggagatccactaaaaaatgatgaagatcatgcccactggacagaagcaaagatgctgcttgacaatatttacaccccagaagggatcattccaacattgtttggtccggaaagggaaaaaacccaagctattgatggagagtttcgccttagaggggaacaaaggaagacttttgtggaattaatgaggagaggagaccttccggtgtggctgagctacaaggtagcttctgctggcatttcttataaagatcgggaatggtgcttcacaggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacgctcatgcttgtagctttactaggtgctatgacagcaggtatcttcctgtttttcatgcaagggaaaggaatagggaaattgtcaatgggtttgatagccattgcggtggctagtggcttgctctgggtagcagaaattcaaccccagtggatagcggcctcaatcatactagagttttttctcatggtactgttgataccagaaccagaaaaacaaaggactccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttggtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgaggacaacatgggctttctgtgaagtcttgactttggccacaggaccaatcttaaccttgtgggagggtaacccgggaaggttttggaacacgaccatagccgtatccaccgccaacattttcaggggaagttacttggcgggggctggactggctttttcactcataaagaatgcacaaacccctaggaggggaactgggaccacaggagagacactgggagagaagtggaagagacagctaaactcattagacagaaaagagtttgaagagtacaaaagaagtggaatactagaagtggacaggactgaagccaagtcagccctgaaagatggatctaaaaccaagcatgcagtatctagagggtccagtaagatcagatggattgttgagagagggatggtaaagccaaaagggaaagttgtagatcttggctgtgggagaggaggttggtcttattacatggcaacactcaagaacgtgactgaagtgaaagggtatacaaaaggaggtccaggacatgaagagccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgtatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacggaaaaaccagacatgacaatcattgggagaaggcttcagcgattgcaagaagagcacaaagaaacctggcattatgatcaggaaaacccatacagaacttgggcgtatcatggaagctatgaagctccttcgacaggctctgcatcctccatggtgaacggggtagtgaaactgctaacaaaaccctgggatgtgattccaatggtgactcagttagccatgacagatacaaccccttttgggcaacaaagagtgttcaaagagaaggtggataccagaacaccacaaccaaaacccggcacacgaatgattatgaccacgacagccaattggctgtgggctctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgataaagaaagggccctacaccaggaagggaaatgtgaatcgtgtgtctacaacatgatgggaaaacgtgagaaaaagttaggagagtttggcagagccaagggaagccgagcaatctggtacatgtggctgggagcgcggtttctggagtttgaagccctgggttttttgaatgaagatcactggtttggcagagaaaattcatggagtggagtggaaggggaaggtctgcacagattgggttatatcctggaggagatagacaagaaggatggagacctaatgtatgctgatgacacagcaggctgggacacaagaatcactgaggatgaccttcaaaatgaagaactgatcacggaacagatggctccccaccacaagatcctagccaaagctattttcaaactaacctatcaaaataaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccatcactttcacaagatctttatgaaagatggccgctcactagtcgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccaatccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 7808 - RNA, 9867 nt, synthetic construct
  misc_feature 1..9867: note = derived and/or modified CDS sequence (wt) from DENV-4__FJ810417__SS-prME
  source 1..9867: mol_type = other RNA
tcaacgataacattactatgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgttacgtataaatgtcccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggggagccctatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatctggtccaaattgagaaccttgagtacacagtggttgtaacagtccacaatggagacacccatgcagtaggaaatgacacatccaatcatggagttacagctacgataactcccaggtcaccatcggtggaagtcaaattgccggactatggagaactaacactcgactgtgaacccaggtctggaattgactttaatgagatgattctaatgaaaatgaaaaagaaaacatggctcgtgcataagcaatggtttttggatctgcctcttccatggacagcaggagcagacacatcagaggttcactggaattacaaagagagaatggtaacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggaaaaattgagaatcaagggaatgtcatacacgatgtgttcaggaaagttctcaatcgacaaagagatggcagaaacacagcatgggacaacagtggtgaaagtcaagtatgaaggtgctggagctccgtgtaaagtccccatagagataagagatgtaaacaaggaaaaagtggttgggcgcgtcatctcatccatccctttggctgagaacaccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacaaactcaaggaatacttcaatggctatgacgtgcatagctgttggaggtatcactctgtttctgggcttcacagttcaagcggacatgggttgtgtggtatcatggagtgggagagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgtcctctgggaaggaggacacgatctcactgtagtggctggggatgtgaagggggtgttgactaaaggcaagagagcactcacacccccagtgagtgatctgaaatattcatggaagacatggggaaaagcaaaaatcttcaccccagaagcaagaaacagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagccgcaattaaagatcagaaagctgtgcatgctgacatgggttattggatagagagctcaaaaaaccagacctggcagatagagaaagcatctcttattgaggtgaaaacatgtctgtggcccaagacccacacactgtggagcaatggagtgctggaaagccagatgctcattccaaaatcatatgcgggccctttttcacagcacaattaccgccagggctatgccacgcaaaccgtgggtccatggcacttaggcaaattagagatagacttcggagaatgccctggaacaacagtcacaattcaggaggattgtgaccatagaggcccatctttgaggaccaccactgcatctggaaaactagtcacgcagtggtgctgccgctcctgcacgatgcctcccttaaggttcttgggagaagatgggtgctggtatggaatggagattaggcctttgaatgaaaaagaagagaacatggtcaaatcacaggtgacggccggacagggcacatcagaaactttttctatgggactgttgtgcctgaccttgtttgtggaagaatgcttgaggagaagagttactaggaaacacatgatattagttgtggtgatcactctttgtgctatcatcctgggaggcctcacatggatggacttactacgagccctcatcatgttaggggacactatgtctggtagaataggaggacagatccacctagccatcatggcagtgttcaagatgtcaccaggatacgtactgggtgtgtttttaaggaaactcacttcaagagagacagcactaatggtaataggaatggccatgacaacggtactttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagcctcttaggaagcgctcttttaaaaaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaagatgaagatggctctttctccatacgggacgtcgaggaaaccaatatgataacccttttggtgaaactggcactgataacagtatcaggtctctaccccctggcaattccagtcacaatgaccttgtggtacatgtggcaagtgaaaacacaaagatcaggagccctgtgggacgtcccttcacccgctgccactcaaaaagctgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccgggaaaaaatcctaaacatgtccaaacgaaacctggccttttcaagaccctaactggagaaattggagcagtaacattggatttcaaacccggcacgtctggttctcccatcatcaacaggaaaggaaaagtcatcggactctatggaaatggagtggttaccaaatcaggcgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctccaacgagagtggtggcggccgagatggaagaggccctccgtggactgccaatccgttatcagactccagctgtgaaatcagaacacacaggaagagagattgtagacctcatgtgtcatgcaaccttcacaacaagacttttgtcatcaaccagggttccgaactacaaccttatagtgatggatgaagcacatttcaccgatccttctagtgttgcggctaggggatacatttcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagctgggagagtgatagaccctagaagatgcctcaagccagttatcctaacagatgggccagagagagtcattttagcaggtcctattccagtgactccagcaagtgctgctcagagaagagggcgaataggaaggaacccagcacaagaagacgaccaatacgttttctccggagatccactaaaaaatgatgaagatcatgcccactggacagaagcaaagatgctgcttgacaatatctacaccccagaagggatcattccaacattgtttggtccggaaagggaaaaaacccaagctattgatggagagtttcgccttagaggggaacaaaggaagacttttgtggaattaatgaggagaggagaccttccggtgtggctgagctacaaggtagcttctgctggcatttcttataaagatcgggaatggtgcttcacaggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctccagggccaagctcgcccttgacaacatagtcatgctccacacaacagaaagaggagggagggcctatcaacacgccctgaacgaacttccggagtcactggaaacgctcatgcttgtagctttactaggtgctatgacagcaggtatcttcctgtttttcatgcaagggaaaggaatagggaaattgtcaatgggtttgatagccattgcggtggctagtggcttgctctgggtagcagaaattcaaccccagtggatagcggcctcaatcatactagagttttttctcatggtactgttgataccagaaccagaaaaacaaaggactccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaatcctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttggtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgaggacaacatgggctttctgtgaagtcttgactttggccacaggaccaatcttgaccttgtgggagggtaacccgggaaggttttggaacacgaccatagccgtatccaccgccaacattttcaggggaagttacttggcgggggctggactggctttttcactcataaagaatgcacaaacccctaggaggggaactgggaccacaggagagacactgggagagaagtggaagagacaactaaactcattagacagaaaagagtttgaagagtacaaaagaagtggaatactagaagtggacaggactgaagccaagtcagccctgaaagatggatctaaaaccaagcatgcagtatctagagggtccagtaagatcagatggattgttgagagagggatggtaaagccaaaagggaaagttgtagatcttggctgtgggagaggaggttggtcttattacatggcgacactcaagaacgtgactgaagtgaaagggtatacaaaaggaggtccaggacatgaagagccgattcccatggctacttatggctggaatttggtcaaactccattcaggggttgacgtgttctacaaacccacagaacaagtggacaccctgctctgtgatattggggagtcatcttctaatccaacaatagaggaaggaagaacattaagagttttgaagatggtggagccatggctctcttcaaaacctgaattctgtatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacggaaaaaccagacatgacaatcattgggagaaggcttcagcgattgcaagaagagcacaaagaaacctggcattatgatcaggaaaacccatacagaacttgggcgtatcatggaagctatgaagctccttcgacaggctctgcatcctccatggtgaacggggtagtgaaactactaacaaaaccctgggatgtgattccaatggtgactcagttagccatgacagatacaaccccttttgggcaacaaagagtgttcaaagagaaggtggataccagaacaccacaaccaaaacccggcacacgaatgattatgaccacgacagccaattggctgtgggctctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggtcgataaagaaagggccctacaccaggaagggaaatgtgaatcgtgtgtctacaacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggttatatcctggaggagatagacaagaaggatggagacctaatgtatgctgatgacacagcaggctgggacacaagaattactgaggatgaccttcaaaatgaagaactgatcacggaacagatggctccccaccacaagatcctagccaaagctattttcaaactaacctatcaaaataaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaagatggccgctcactagtcgttccatgtagaaaccaggatgaactgatagggagagccagaatctcgcagggggctggatggagcttaagagaaacagcctgcctcggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccaatccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 7809 - RNA, 9867 nt, synthetic construct
  misc_feature 1..9867: note = derived and/or modified CDS sequence (wt) from DENV-4__FJ850057__SS-prME
  source 1..9867: mol_type = other RNA
tcaacgataacattactgtgcttgattcccaccgcaatggcgtttcacttgtcaacaagagatggcgaacccctcatgatagtggcaaaacatgagagggggagacctctcttgtttaagacaacagaggggatcaacaaatgcactctcattgccatggacttgggtgaaatgtgtgaggacactgttacgtataaatgtcccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaaccgtcttctttgtcctaatgatgctggtcgccccatcctatggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggggagccctatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatctggtccaaattgagaaccttgagtacacagtggttgtaacagtccacaatggagacacccatgcagtaggaaatgacacatccaatcatggagttacagctacgataactcccaggtcaccatcggtggaagtcaaattgccggactatggagaactaacactcgactgtgaacccaggtctggaattgactttaatgagatgattctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagctatgcattctgccctcgctggagccacagaagtggactccggtgatggaaatcacatgtttgcaggacatctcaagtgcaaagtccgtatggaaaaattgagaatcaagggaatgtcatacacgatgtgttcaggaaagttctcaatcgacaaagagatggcagaaacacagcatgggacaacagtggtgaaagtcaagtatgaaggtgctggagctccgtgtaaagtccccatagagataagagatgtaaacaaggaaaaagtggttgggcgcgtcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgctaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacaaactcaaggaatacttcaatggctatgacgtgcatagctgttggaggtatcactctgtttctgggcttcacagttcaagcggacatgggttgtgtggtatcatggagtgggagagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgtcctctgggaaggaggacacgatctcactgtagtggctggggatgtgaagggagtgttgactaaaggcaagagagcactcacacccccagtgagtgatctgaaatattcatggaagacatggggaaaagcaaaaatcttcaccccagaagcaagaaacagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaggtgaaaacatgtctgtggcccaagacccacacactgtggagcaatggagtgctggaaagccagatgctcattccaaaatcatatgcgggccctttttcacagcacaattaccgccagggctatgccacgcaaaccgtgggtccatggcacttaggcaaattagagatagacttcggagaatgccccggaacaacagtcacaattcaggaggattgtgaccatagaggcccatctttgaggaccaccactgcatctggaaaactagtcacgcagtggtgctgccgctcctgcacgatgcctcccttaaggttcttgggagaagatgggtgctggtatggaatggagattaggcctttgaatgaaaaagaagagaacatggtcaaatcacaggtgacggccggacagggcacatcagaaactttttctatgggactgttgtgcctgaccttgtttgtggaagaatgcttgaggagaagagttactaggaaacacatgatattagttgtggtgatcactctttgtgctatcatcctgggaggcctcacatggatggacttactacgagccctcatcatgttaggggacactatgtctggtagaataggaggacagatccacctagccatcatggcagtgttcaagatgtcaccaggatacgtactgggtgtgtttttaaggaaactcacttcaagagagacagcactaatggtaataggaatggccatgacaacggtactttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagcctcttaggaagcgctcttttaaaaaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaagatgaagatggctctttctccatacgggacgtcgaggaaaccaatatgataacccttttggtgaaactggcactgataacagtatcaggtctctaccccctggcaattccagtcacaatgaccttgtggtacatgtggcaagtgaaaacacaaagatcaggagccctgtgggacgtcccctcacccgctgccactcaaaaagctgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattggatttcaaacccggcacgtctggttctcccatcatcaacaggaaaggaaaagtcatcggactctatggaaatggagtggttactaaatcaggcgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctccaacgagagtggtggcggccgagatggaagaggccctacgtggactgccaatccgttatcagactccagctgtgaaatcagaacacacaggaagagagattgtagacctcatgtgtcatgcaaccttcacaacaagacttttgtcatcaaccagggttccgaattacaaccttatagtgatggatgaagcacatttcaccgatccttctagtgttgcggctaggggatacatttcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagctgggagagtgatagaccctagaagatgcctcaagccagttatcctaacagatgggccagagagagtcattttagcaggtcctattccagtgactccagcaagtgctgctcagagaagagggcgaataggaaggaacccagcacaagaagacgaccaatacgttttctccggagatccactaaaaaatgatgaagatcatgcccactggacagaagcaaagatgctgcttgacaatatctacaccccagaagggatcattccaacattgtttggtccggaaagggaaaaaacccaagctattgatggagagtttcgccttagaggggaacaaaggaagacttttgtggaattaatgaggagaggagaccttccggtgtggctgagctacaaggtagcttctgctggcatttcttataaagatcgggaatggtgcttcacaggggaaagaaataaccaaattttagaagagaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctgacagagattgccagtttgccaacttacctttcctctagggccaagctcgcccttgacaacatagtcatgctccacacaacagaaagaggagggagggcctatcaacacgccctgaacgaacttccggagtcactggaaacgctcatgcttgtagctttactaggtgctatgacagcaggtatcttcctgtttttcatgcaagggaaaggaatagggaaattgtcaatgggtttgatagccattgcggtggctagtggcttgctctgggtagcagaaattcaaccccagtggatagcggcctcaatcatactagagttttttcttatggtactgttgataccagaaccagaaaaacaaaggactccacaagacaatcaattgatctacgtcatattgaccattctcaccattattggtctaatagcagccaacgagatggggctgattgaaaaaacaaaaacggattttgggttttaccaggtgaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttggtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgaggacaacatgggctttctgtgaagtcttgactttggccacaggaccaaccttgaccttgtgggagggtaacccgggaaggttttggaacacgaccatagccgtatccaccgccaacattttcaggggaagttacttggcgggggctggactggctttttcactcataaagaatgcacaaacccctaggaggggaactgggaccacaggagagacactgggagagaagtggaagagacagctaaactcattagacagaaaagagtttgaagagtacaaaagaagtggaatactagaagtggacaggactgaagctaagtcagccctgaaagatggatctaaaaccaagcatgcagtatctagagggtccagtaagatcagatggattgttgagagagggatggtaaagccaaaagggaaagttgtagatcttggctgtgggagaggaggttggtcttattacatggcgacactcaagaacgtgactgaagtgaaagggtatacaaaaggaggtccaggacatgaagagccgattcccatggctacttatggctggaatttggtcaaactccattcaggggttgacgtgttctacaaacccacagaacaagtggacaccctgctctgtgatattggggagtcatcttctaatccaacaatagaggaaggaagaacattaagagttttgaagatggtggagccatggctctcttcaaaacctgaattctgtatcaaagtcctcaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacggaaaaaccagacatgacaatcattgggagaaggcttcagcgattgcaagaagagcacaaagaaacctggcattatgatcaggaaaacccatacagaacttgggcgtatcatggaagctatgaagctccttcgacaggctctgcatcctccatggtgaacggggtagtgaaactgctaacaaaaccctgggatgtgattccaatggtgactcagttagccatgacagatacaaccccttttgggcaacaaagagtgttcaaagagaaggtggataccagaacaccacaaccaaaacccggcacacgaatgattatgaccacgacagccaattggctgtgggctctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgataaagaaagggccctacaccaggaagggaaatgtgaatcgtgtgtctacaacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggcctgcacagattgggttatatcctggaggagatagacaagaaggatggagacctaatgtatgctgatgacacagcaggctgggacacaagaatcactgaggatgaccttcaaaatgaagaactgatcacggaacagatggctccccaccacaagatcctagccaaagctattttcaaactaacctatcaaaataaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaagatggccgctcactagtcgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccaatccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggactacatgccagtaatgaaaagatacagtgctccttcagagagtgaaggagttctgtaa

SEQ ID NO: 7810 - RNA, 9867 nt, synthetic construct
  misc_feature 1..9867: note = derived and/or modified CDS sequence (wt) from DENV-4__GQ199881__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaagaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacagttcaagcggacatgggttgtgtagtgtcatggagtgggagagagttgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaagattgtgaccatagaggcccatctttgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaaatcacaggtggcggccggacagggcacatcagaaactttttttatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcatgatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggatcgtctggttctcccattatcaacaggaaaggaaaagtcatcggactctatggaaatggagtggtcaccaaatcaggtgattacgtcagtgccataacgcaagccgaaagaattggagagccagattatgaagtggatgaggatatttttcgaaagaaaagattaactataatggacttacaccccggagctggaaagacaaaaagaattcttccatcaatagtgagagaagccttaaaaaggaggctgcgaactttgattctggctcccacgagagtggtggcggccgagatggaagaggccctacgtggactgccaatccgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagcttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattggccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacaggaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccatcactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaagtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 7811 - RNA, 9867 nt, synthetic construct
  misc_feature 1..9867: note = derived and/or modified CDS sequence (wt) from DENV-4__GQ199882__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgttacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaaaggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcggacatgggttgtgtggtgtcatggagtgggagagagttgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaaatcacaggtggcggccggacagggcacatcagaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctctaccctttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaggtggatgaggatatttttcgaaagaaaagattaactataatggacttacaccccggagctggaaagacaaaaagaattcttccatcaatagtgagagaagccttaaaaaggaggctgcgaactttgattctggctcccacgagagtggtggcggccgagatggaagaggccctacgtggactgccaatccgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggtcagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagcttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcttcaatcatactggagttttttctcatggtactgttgataccagaaccagaaaaacaaaggaccccacaagacaatcaattgatctacgtcatattaaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaaacaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcagctcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctctcaccactttcacaagatctttatgaaggatggccgctcactagttgttccatgtagaaaccaggatgaactgatagggagagccagaatctcgcaaggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccaatggatgaccactgaagacatgctcaaagtgtggaacagagtgtggatagaagacaaccccaatatgattgacaagaccccagtccattcgtgggaagatataccttacctagggaaaagagaggatttgtggtgtggatccctgattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 7812 - RNA, 9867 nt, synthetic construct
  misc_feature 1..9867: note = derived and/or modified CDS sequence (wt) from DENV-4__GQ199883__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggcagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaattcaaggaacacttcaatggccatgacgtgcatagctgttggaggaatcactctgtttttgggcttcacagttcaagcggacatgggttgtgtggtgtcatggagtgggagagagttgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaagattgtgaccatagaggcccatctttgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaaatcacaggtggcggccggacagggcacatcagaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcaatgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggatatttttcgaaagaaaagattaactataatggacttacaccccggagctggaaagacaaaaagaattcttccatcaatagtgagagaagccttaaaaaggaggctgcgaactttgattctggctcccacgagagtggtggcggccgagatggaagaggccctacgtggactgccaatccgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatatgctgaccccatggctttgaaggatttcaaggagtttgccagtggaaggaagagtataactctcgacatcctaacagagattgccagcttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattggccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagctgtatccaccgccaacattttcaggggaagttacttggcgggagctggactggctttttcactcataaagaatgcacaaacccctaggaggggaactgggaccacaggagagacactgggagagaagtggaagagacagctaaactcattagacaggaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccatcactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaagtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 7813 - RNA, 9867 nt, synthetic construct
  misc_feature 1..9867: note = derived and/or modified CDS sequence (wt) from DENV-4__GQ199884__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaattcaaggaacacttcaatggccatgacgtgcatagctgttggaggaatcactctgtttttgggcttcacagttcaagcggacatgggttgtgtggtgtcatggagtgggagagagttgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaagattgtgaccatagaggcccatctttgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaagtcacaggtggcggccggacagggcacatcagaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacatatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggatatttttcgaaagaaaagattaactataatggacttacaccccggagctggaaagacaaaaagaattcttccatcaatagtgagagaagccttaaaaaggaggctgcgaactttgattctggctcccacgagagtggtggcggccgagatggaagaggccctacgtggactgccaatccgttaccagaccccagctgtgaaatcagaacacacaggaagagagattgtagaccttatgtgtcatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatatgctgaccccatggctttgaaggatttcaaggagtttgccagtggaaggaagagtataactctcgacatcctaacagagattgccagcttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggcatcttcctgtttttcatgcaagggaaaggaatagggaaattgtcaatgggtttgataaccattgcggtggctagtggcttgctttgggtagcagaaattcaaccccagtggatagcggcctcaatcatactggagttttttctcatggtactgttgataccagaaccagaaaaacaaaggaccccacaagacaatcaattgatctacgtcatattggccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagctgtatccaccgccaacattttcaggggaagttacttggcgggagctggactggctttttcactcataaagaatgcacaaacccctaggaggggaactgggaccacaggagagacactgggagagaagtggaagagacagctaaactcattagacaggaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccatcactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaagtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 7814 - RNA, 9867 nt, synthetic construct
  misc_feature 1..9867: note = derived and/or modified CDS sequence (wt) from DENV-4__FJ882595__SS-prME
  source 1..9867: mol_type = other RNA
tcaacgataacattgttgtgcttgattcccaccgcaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgctaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatatacgatgtgttcaggaaagttttcaattgacaaagagatggcagaaacacagcatgggacaacagtggtgaaagtcaagtatgaaggcgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcggacatgggttgtgtggtgtcatggagtgggagagagttgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatccttgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaaatcacaggtggcggccggacagggcacttcagaaactttttctatgggtctgttgtgcctgaccttgtttgtggaagaatgcttgaggagaagagtcactaggaaacacatgatattagccgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagctcaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctctaccctttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacactagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggatatttttcgaaagaaaagattaactataatggacttacaccccggagctggaaagacaaaaagaattcttccatcaatagtgagagaagccttaaaaaggaggctgcgaactttgattctggctcccacgagagtggtggcggccgagatggaagaggccctacgtggactgccaatccgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagcttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggcatcttcctgttcttcatgcaagggacaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacgattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaaccccacagtggacgggataacagtaatagatctagaaccaatatcctatgacccaaaatttgaaaaacaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggccacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtggatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcatagattgggatacatcctggaggagatagacaagaaagatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgtcaaatggaagctgaaggagtcatcacacaagatgacatgcagaacccaaaagggttgaaagaaagagttgagaagtggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctctcaccactttcacaagatctttatgaaggatggccgctcactagttgttccatgtagaaaccaggatgaactgatagggagagccagaatctcgcagggggctggatggagtttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccaatggatgaccactgaagacatgctcaaagtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 7815 - RNA, 9867 nt, synthetic construct
  misc_feature 1..9867: note = derived and/or modified CDS sequence (wt) from DENV-4__FJ882596__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgtacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgctaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggcgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcggacatgggttgtgtggtgtcatggagtgggagagagttgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaggggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacacaaaccgtgggcccatggcacttaggcaaactagagatagactttggagaatgccccggaacaacagtcacaattcaggaggattgtgaccatagaggcccatccttgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaaatcacaggtggcggccggacagggcacttcagaaactttttctatgggtctgttgtgcctgaccttgtttgtggaagaatgcttgaggagaagagtcactaggaaacacatgatattagccgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagctcaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctctaccctttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacactagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggatatttttcgaaagaaaagattaactataatggacttacaccccggagctggaaagacaaaaagaattcttccatcaatagtgagagaagccttgaaaaggaggctgcgaactttgattctggctcccacgagagtggtggcggccgagatggaagaggccctacgtggactgccaattcgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagcttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggcatcttcctgttcttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaaacaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggccacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtggatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagctataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgtcaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctctcaccactttcacaagatctttatgaaggatggccgctcactagttgttccatgtagaaaccaggatgaactgatagggagagccagaatctcgcagggggctggatggagtttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaagtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 7816 - RNA, 9867 nt, synthetic construct
  misc_feature 1..9867: note = derived and/or modified CDS sequence (wt) from DENV-4__FJ850059__SS-prME
  source 1..9867: mol_type = other RNA
tcaacaataacattgttgtgcttgattcccactgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctattggtcaataccgaacctgaagacattgattgctggtgcaacctcacgtctacctgggtcatgtatggaacatgcacccagagtggagaacggagacgagagaagcgctcagtagctttaacaccacattcaggaatgggattggaaacaagagctgagacatggatgtcatcggaaggggcttggaagcatgctcagagagtggagagctggatactcagaaacccaggatttgcgctcttggcaggatttatggcttacatgattgggcaaacaggaatccagcgaactgtcttctttgtcctaatgatgctggtcgccccatcctacggaatgcgatgcgtaggagtaggaaacagagactttgtggaaggagtctcaggtggagtatgggtcgacctggtgttagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatctaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatttgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggtttaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacctgcatagctgttggaggaatcactctgtttttgggctttacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaattgcccacaaagatggggtctgtggaattagatcaaccacgaggctggaaaatgttatgtggaagcaaataaccaatgagcttaactatgttctctgggaaggaggacatgatctcactgtagtggctggggatgcgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggtatgtttacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccctagctctttccttgactttcataagatcaacaatgtcattggtcatggcttggaggaccattatggctgtgttgtttgtggtcacactcattcccttgtgcaggacaagctgtcttcagaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggctattcgggaaaactcaggttggagtagggatacacatggaaggtgtatttcacacaatgtggcatgttacaagaggatcagtgatctgccacgagactgggagattggagccatcttgggctgacgtcaggaatgacatgatatcatacggtggaggatggaggcttggagacaaatgggacaaagaagaagacgttcaggtcctcgctatagaaccaggaaaaaatcccaaacatgtccaaacgaaacctggccttttcaagaccttaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgatactggctcccacgagagtggtggcggccgagatggaagaggccctacgtggactgccaatccgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgactagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgacacagaatatccaaaaacgaaactcacggactgggactttgtggtcactacagatatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcactggggaaagaaataaccaaattttggaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctaccaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccatcattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggctcagaaaaggacagctgctggaatcatgaaaaatccaacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttaaccttgtgggagggcaacccgggaaggttttggaacacgaccatagccgtatccaccgccaacattttcaggggaagttacttggcgggagctggattggctttttcactcataaagaatgcacaaacccctaggagggggactgggaccacaggagagacactgggagagaagtggaagagacagctaaactcattagacaggaaagagtttgaagagtataaaagaagtggaatactagaagtggacaggactgaagccaagtctgccctgaaagacgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacagacccacagagcaagtggacaccctgctctgtgatattggggagtcatcttctaatccaacaatagaggaaggaagaacattaagagttctgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactctacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaggagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaaattaggagagtttggaagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggctgaaagaaagagttgagaaatggctgagagagtgtggtgtcgacaggttaaagaggatggcaatcagtggagacgactgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacgacatggtcaatccatgctcatcaccaatggatgaccactgaagacatgctcaaagtgtggaacagagtgtggatagaagacaaccccaatatgattgacaagactccagtccattcgtgggaagatataccttacctagggaaaagagaggatttgtggtgtggatccctgattgggctttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 7817 - RNA, 9867 nt, synthetic construct
  misc_feature 1..9867: note = derived and/or modified CDS sequence (wt) from DENV-4__FJ882598__SS-prME
  source 1..9867: mol_type = other RNA
tcaacgataacattgttgtgcttgattcccaccgcaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgttacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttacatgattgggcagacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctcttttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggacctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaatatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcggacatgggttgtgtggtgtcatggagtgggagagagttgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatctttacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaaatcacaggtggcggccggacagggcacatcagaaactttttctatgggtctgttgtgcctgaccttgtttgtggaagaatgcctgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccagggtacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagagataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaggtggatgaggatatttttcgaaagaaaagattaactataatggacttacaccccggagctggaaagacaaagagaattcttccatcaatagtgagagaagccttaaaaaggaggctgcgaactttgattctggctcccacgagagtggtggcggccgagatggaagaggccctacgtggactgccaatccgttaccagaccccagctgtgaaatcagaacacacaggaagagagattgtagacctcatgtgtcatgcaactttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtagaaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccattaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagcttgccaacttacctttcctctagggccaagctcgcccttgacaacatagtcatgctccacacaacagaaagaggagggagggcctatcaacacgccctgaacgaacttccggagtcactggaaacactcatgcttgtagccttattaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcttcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaaacaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaaggtttgaaagaaagagttgagaaatggctgagagagtgtggtgtcgacagattaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctctcaccactttcacaagatctttatgaaggatggccgctcattagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccaatggatgaccactgaagacatgctcaaagtgtggaacagagtgtggatagaagacaaccccaatatgattgacaagaccccagtccattcgtgggaagatataccttacctagggaaaagagaggatttgtggtgtggatccctgattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 7818 - RNA, 9867 nt, synthetic construct
  misc_feature 1..9867: note = derived and/or modified CDS sequence (wt) from DENV-4__FJ882601__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcggtgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagctaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacgttcaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacattgtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtacaccaggtttttggaagcgtgtatacaaccatgtttggaggagtctcatggatgattagaatcctaattgggttcttagtgttgtggattggcacgaattcaaggaacacttcaatggccatgacgtgcatagctgttggaggaattactctgtttttgggcttcacagttcaagcggacatgggttgtgtggtgtcatggagtgggagagagttgaagtgtggaagcggaatctttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagtacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgccattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggtaaactagagatagactttggagaatgccccggaacaacagtcacaattcaggaagattgtgaccatagaggcccatctttgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaaatcacaggtggcggccggacagggcacatcagaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactctcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaataatagaagtgaagcaagatgaggatggctctttctccatacgggacgtcgaggaaaccaatatgataacccttttggtgaagctggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacatatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcctattgtcaacaggaaaggaaaagtcatcggactctatggaaatggagtggtcaccaaatcaggtgattacgtcagtgccataacgcaagccgaaagaattggagagccagattatgaagtggatgaggatatttttcgaaagaaaagattaactataatggacttacaccccggagctggaaagacaaaaagaattcttccatcaatagtgagagaagccttaaaaagaaggctgcgaactttgattctggctcccacgagagtggtggcggccgagatggaagaggccctacgtggactgccaatccgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattttagaagaaaacatggaggttgaaatttggactagagagggagaaaagaaaaaactgaggccaagatggttggatgcacgtgtatacgctgaccccatggctttgaaggatttcaaggagtttgccagtggaaggaagagtataactctcgacatcctaacagagattgccagcttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggcatcttcctgttttttatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattggccattctcaccattattggtctaatagcagccaacgagatggggctgatagaaaaaacaaaaacggattttgggttttaccaggaaaaaacagaaaccaccatcctcgatgtggacttgagaccagcttcagcatggacgctctatgcggtagccaccacaattttaactcccatgctgagacacactatagaaaacacgtcggccaacctatctctaacagccattgccaaccaggcagccgtcctaatgggacttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggccctgaaaaggacagctgctggaatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagctgtatccaccgccaacattttcaggggaagttacttggcgggagctggactggctttttcactcataaagaatgtacaaacccctaggaggggaactgggaccacaggagagacactgggagagaagtggaagagacagctaaactcattagacaggaaagagtttgaagagtataaaagaagtggaatactagaagtggacaggactgaagccaagtccgccctgaaagatgggtctaaaatcaagcatgcagtatctagagggtccagtaagatcagatggattgttgagagagggatggtaaagccaaaggggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtcctcaacccctacatgccaacagtcatagaagagctggagaaactgcagagaaaacacggtgggaaccttgtcagatgcccgctgtccaggaactccacccatgagatgtattgggtgtcaggagcgtcgggaaatattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacgccgcaaccaaaaccaggcacacgaatggttatgaccacgacagccaattggctatgggccctccttggaaagaagaaaaatcccagactgtgtacaagggaagagttcatctcaaaagttagatcaaacgcagccataggcgcagtctttcaggaagaacaaggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggttgggacacaagaatcactgaggatgaccttcaaaatgaggaactggtcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccatcactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaagtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaacttgatcggaaaagaggaatacgtggattacatgccagtaatgaaaagatacagtgctccttcagagagtgaaggagttctgtaa

SEQ ID NO: 7819 - RNA, 9867 nt, synthetic construct
  misc_feature 1..9867: note = derived and/or modified CDS sequence (wt) from DENV-4__FJ226067__SS-prME
  source 1..9867: mol_type = other RNA
tcaacgataacattgctgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctagtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggggagccctatctgaaagaggaacaggaccaacagtacatttgccggagagatgtggtagacagagggtggggcaatggttgtggcttgtttggaaaaggaggagttgtgacatgtgcgaagttttcatgttcggggaagataacaggcaatctggtccaaattgagaaccttgagtatacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgattctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggaaaaattgagaatcaagggaatgtcatacacgatgtgctcaggaaagttctcaatcgacaaagagatggcagaaacacagcatgggacaacagtggtgaaagtcaagtatgaaggtgctggagctccgtgtaaagtccccatagagataagagatgtaaacaaggaaaaagtggttgggcgcgtcatctcatccacccctttggctgagaataccaacagtgtaaccaacatagaattagaacccccctttggggacagctacatagtgataggtgttggaaacagcgcattaacactccattggttcaggagagggagttccattggcaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacaaactcaaggaacacttcaatggctatgacgtgcataactgttggaggtatcactctgtttctgggcttcacagttcaagcggacatgggttgtgtggtatcatggagtgggagagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgccctctgggaaggaggacacgatctcactgtagtggctggggatgtgaagggggtgttgaccaaaggcaagagagcactcacacccccagtgagtgatctgaaatattcatggaagacatggggaaaagcaaaaatcttcaccccagaagcaagaaacagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaatcagacctggcagatagagaaagcatctcttattgaagtgaaaacatgtctgtggcccaagacccacacactgtggagcaatggagtactggaaagccagatgctcattccaaaatcatatgcgggccctttttcacagcacaattaccgccagggctatgccacgcaaaccgtgggtccatggcacttaggcaaattagagatagacttcggagaatgccccggaacaacagtcacaattcaggaggattgtgaccatagaggcccatctttgaggaccaccactgcatctggaaaactagtcacgcagtggtgctgccgctcctgcacgatgcctcccttaaggttcttgggagaagatgggtgctggtatggaatggagattaggcccttgagtgaaaaagaagagaacatggtcaaatcacaggtgacggccggacagggcacatcagaaactttttctatgggactgttgtgcctgactttgtttgtggaagaatgcttgaggagaagagtcactaggaaacacatgatattagttgtggtaatcactctttgtgctatcatcctgggaggcctcacatggatggacttactacgagccctcatcatgttaggggacactatgtctggtagaataggaggacagatccacctagccatcatggcagtgttcaagatgtcaccaggatacgtgctgggtgtgtttttaaggaaactcacttcaagagagacagcactaatggtgataggaatggccatgacaacggtactttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtctccaaaaacagtctcattgggtagaaataacagcactcatcctaggagcccaagctctgccagtgtacctaatgactcttatgaaaggagcctcaagaagatcttggcctctcaacgagggcataatggctgtgggtttggttagtctcttaggaagcgcccttttaaaaaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaagatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggttctcgccatagaaccaggaaaaaatcctaaacatgtccaaacgaaacctggccttttcaagaccctaactggagaaattggagcagtaacattggatttcaaacccggaacgtctggttctcccatcatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagggttccgaattacaaccttatagtgatggatgaagcacatttcaccgatccttctagtgttgcggctaggggatacatttcgaccagggtggaaatgggagaggcagcagccatcttcatgactgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggattttgtggtcactacagacatatctgaaatgggggccaattttagagctgggagagtgatagaccctagaagatgcctcaagccagttatcctaacagatgggccagagagagtcattttagcaggtcctattccagtgactccagcaagtgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctacaaggtagcttctgctggcatatcttataaagatcgggagtggtgcttcacaggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctccagggccaagctcgcccttgataacatagtcatgctccacacaacagaaagaggagggagggcctatcaacacgccctgaacgaacttccagagtcactggaaacactcatgcttgtagctttactaggtgctatgacagcaggtatcttcctatttttcatgcaagggaaaggaatagggaaattgtcaatgggtttgatagccattgcggtggctagtggtttgctctgggtagcagaaattcaaccccagtggatagcggcctcaatcatactagagttttttctcatggtactgttgataccagaaccagaaaaacaaaggactccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgctagcaatgggatgctattcccaagtgaacccaacaaccttgacagcatccttagtcatgcttttagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggtaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtacaaaagaagtggaatactagaagtggacaggactgaagccaagtcagccctgaaagatgggtctaaaatcaagcatgcagtatctagagggtccagcaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccgggacatgaagagccaattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagtcttgaagatggtggagccatggctctcttcaaaacctgaattctgtatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacggaaaaaccagacatgacaatcattgggagaaggcttcagcgattgcaagaagagcacaaagaaacctggcattatgatcaggagaacccatacagaacctgggcgtatcatggaagctatgaagctccttcgacaggctctgcatcctccatggtgaacggggtagtgaaactgctaacaaaaccctgggatgtgattccaatggtgactcagttagccatgacagatacaaccccttttgggcaacaaagagtgttcaaagagaaggtggataccagaacaccacaaccaaaacccggcacacgaatggttatgaccacgacagccaattggctgtgggctctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgataaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggttatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaataaagtggtgaaagtcctcagacccacaccgagaggagcggtgatggatatcatatccaggaaagaccaaagaggcagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagtcgttccatgtagaaaccaggatgagctaatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagaccccagtccattcgtgggaagatataccttacctagggaaaagagaggatttgtggtgtggatccttgattggactttcttctagagccacctgggcgaagaacattcacacggccataacccaggtcaggaacctgatcggaaaagaggaatacgtagattacatgccagtaatgaaaagatacagtgctctttcagagagtgaaggagttctgtaa

SEQ ID NO: 7820 - RNA, 9867 nt, synthetic construct
  misc_feature 1..9867: note = derived and/or modified CDS sequence (wt) from DENV-4__EU854299__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagattttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggagttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggttcttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcgggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgctcacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctctcattgaagtaaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtccgaaggagtgtacaggatcatgcaaagagggttattcgggaaaactcaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagacaaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtggttaccaaatcaggtgactacgtcagtgccataacgcaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgacagcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgcccagagaagagggcgaataggaaggaacccagcacaagaagacgaccaatacgttttctccggagacccactaaaaaatgatgaagatcatgcccactggacagaagcaaagatgctgcttgacaatatctacaccccagaaggaatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggcttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccacaggagagacactgggagagaagtggaagagacaactaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccagggcatgaagaaccgattcccatggctacttatggctggaatttggtcaaactccattcaggggttgacgtgttctacaaacccacagagcaggtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagatacaaccccttttgggcaacaaagagtgttcaaagagaaggtggataccagaacaccgcaaccaaaaccaggcacacgaatggtcatgactacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagccgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaagatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7821 - RNA, 9867 nt, synthetic construct
  misc_feature 1..9867: note = derived and/or modified CDS sequence (wt) from DENV-4__FJ182016__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtccacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggtccctcatgccaagagacaggatgtgacagtgctgggatctcaggaaggagccatgcattctgccctcgctggagccacagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacaaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttaggcaaactagagatagactttggagaatgccccggaacaacagtcacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagccgtggtaatcactctttgtgctatcatcctggggggcctcacatggatggacttgctacgagccctcatcatgttgggggacactatgtctggtagaataggaggacagacccacctagccatcatggcagtgttcaagatgtcaccgggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgccttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcttgggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtaggaatacacatggaaggtgtatttcacacaatgtggcatgttacaagaggatcggtgatctgccacgagactgggagattggagccatcttgggctgatgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacacaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatctcgaccagggtggaaatgggagaggcagcagccatcttcatgaccgcaacccctcccggagcgacagatccttttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgttattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagttttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgagagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaactcatggagtggagtggaaggggaaggtctgcacagattgggatacatcctggaggagatagacaagaaggatggggacctaatgtatgctgatgacacagcaggctgggacacaagaatcactgaggatgatcttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaacgacatgggaaaggtgaggaaagatattccgcagtgggaaccatctaagggatggaaaaactggcaagaggttcctttttgctcccaccactttcacaggatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7822 - RNA, 9867 nt, synthetic construct
  misc_feature 1..9867: note = derived and/or modified CDS sequence (wt) from DENV-4__EU854300__SS-prME
  source 1..9867: mol_type = other RNA
tcaacgattacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagccttaacaccacattcaggaatgggattggaaacaagagctgagacatggatgtcatcggaaggggcttggaagcatgctcagagagtagagagctggatactcagaaacccaggatttgcactcttggcaggatttatggcttacatgattgggcaaacagggatccagcgaactgtcttctttgtcctaatgatgctggtcgccccatcctacggaatgcgatgcgtaggagtgggaaacagagactttgtggaaggagtctcaggtggagcatgggtcgacctggtgctagaacatggaggatgcgttacaaccatggcccagggaaaaccaaccttggattttgaactaaccaagacaacagccaaggaagtggctctgttaagaacctattgcattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtgaccaacatagaattagaacccccctttggggacagttacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtacaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggaatgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaaaacatgggggaaagcaaaaatcttcacccctgaaacaagaaacagcacatttttaatagatggaccagacacctctgaatgccccaatgaacgaagagcgtggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttaggcaaactagagatagactttggagaatgccccggaacaacagtcacaattcaggagaattgtgaccatagaggcccatctttgaggaccaccactgcatctggaaaactagtcacacaatggtgttgccgctcctgcacgatgccccccttaaggttcttaggagaagatgggtgctggtatgggatggagattaggcccttgagtgaaaaagaagagaacatggttaaatcacaggtgacggctggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtggggatacacatagaaggtgtatttcacacaatgtggcatgttacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaaggattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaagcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgctcagagaagagggcgaataggaaggaacctagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaagtagcttctgctggcatttcttacaaagatcgggaatggtgcttcactggggagagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgataacatagttatgcttcacacaacagaaagaggagggagggcctatcaacacgccctgaacgaacttccggagtcactggaaacactcatgcttgtagccttactaggtgctatgacagcaggtatcttcctgtttttcatgcaagggaaagggatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcggccaacgagatggggctgatagaaaaaacaaaagcggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccacttcacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaagaacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacatttttaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtgtctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccttggctctcttcaaaacctgaattctgcatcaaagtccttaacccctacatgccaacagtcatagaagagctggaaaaactgcagagaaaacatggtgggaaccttgtcagatgcccgctgtccaggaactccacccatgagatgtattgggtgtcaggagcgtcgggaaacatcgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaatccatacagaacctgggcgtatcatggaagctatgaagctccttcgacaggctctgcgtcctccatggtgaacggggtggtgaaactgctaacaaaaccctgggatgtaattccaatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcactagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaactcatggagtggagtggaaggggaaggtctgcatagattgggatacatcctggaggagatagacaagaaggatggagacctaatgtatgctgatgacacagcaggctgggacacaagaatcactgaggatgatcttcaaaatgaggaactgatcacggaacagatggctccccaccacaagatcctagccaaagccatttttaaactaacctatcaaaacaaagtggtgaaagtcctcagacccacaccgagaggagcggtgatggatatcatatccaggaaagaccagagaggtagtggacaagttgggacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaatgacatgggaaaggtgaggaaagatattccgcagtgggaaccatctaagggatggaaaaactggcaagaagttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctacgtctagcctccatggccatatgctcagcagttccaacggaatggtttccaacaagtagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7823 - RNA, 9867 nt, synthetic construct
  misc_feature 1..9867: note = derived and/or modified CDS sequence (wt) from DENV-4__FJ182017__SS-prME
  source 1..9867: mol_type = other RNA
tcaacgataacattgttgtgcttgattcccaccgtgatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctgcctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtaaccaacatagaattggaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagacggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgcctgtggcccaagacccatacactgtggagcaatggagtgctggaaagccagatgcttattccaaaatcatatgcgggccctttttcacagcacaattaccgccagggctatgctacgcaaaccgtgggtccatggcacttaggcaaactagagatagactttggagaatgccccggaacaacagtcacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcctaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcatgggctgacgtcaggaatgatatgatatcatacggtgggggatggaggcttggagataaatgggacaaagaagaagacgttcaggtcctcgctatagaaccaggaaaaaatcccaaacatgtccaaacgaaacctggccttttcaagaccctgactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaaggattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttactctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctactctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgccttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacatttttaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaaaaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccttacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgatcttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgataggttaaagaggatggcaattagtggagatgattgcgtggtgaaacccctagatgagaggtttggcacttccctcctcttcttgaacgacatgggaaaggtgaggaaagatattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggtaaagcttacgcccagatgtggtcgcttatgtacttccacagaagggatctgcgtctagcctccatggccatatgctcagcagttccaacggaatggtttccaacaagcagaacaacatggtcaatccatgctcaccaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7824 - RNA, 9867 nt, synthetic construct
  misc_feature 1..9867: note = derived and/or modified CDS sequence (wt) from DENV-4__EU854301__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgtattgaagcctcaatatcaaacataactacggcaacaagatgtccaacgcagggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaataaggaaaaagtggttgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccagatttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacagattaatgtcagctgcaattaaagaccagaaagctgtgcatgctgacatgggttattggatagagagctcaaaaaaccagacctggcagatagagagagcatctcttattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttaggcaaactagagatagactttggagaatgccccggaacaacagtcacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagttaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactctcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttctggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaagccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcctagcataaaggctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcgagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggagcaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgctagtttgccaacttacctctcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatggggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactattcttgatgagaacaacatgggctttctgtgaagtcttgactttggccacaggaccaatcttgaccttgtgggagggcaacccgggaaggttttggaacacgactatagccgtatctaccgccaatattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtgtctagagggtccagtaagatcagatggattgttgagagaggaatggtaaagccaaaagggaaagttgtagatcttggctgtgggagaggaggatggtcttattacatggcgacactcaagaacgtgactgaagtgaaagggtatacaaaaggaggtccaggacacgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaatcttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagagaaaccagacatgacaatcattgggaggaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgttaacaaaaccctgggatgtaattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgatcttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaacgacatgggaaaggtgaggaaagatattccgcagtgggaaccatctaagggatggaaaaactggcaagaggtccctttttgctcccaccactttcacaagatctttatgaaggatggccgctcactagttgttccatgcagaaaccaggatgaactgatagggagagccagaatctcgcagggggctggatggagcttaagggaaacagcctgcctaggcaaagcttacgcccagatgtggtcgcttatgtacttccacagaagggatctgcgcttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgatagacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagcaatgaaaagatacagtgctccttcagagagtgaaggagttctgtaa

SEQ ID NO: 7825 - RNA, 9867 nt, synthetic construct
  misc_feature 1..9867: note = derived and/or modified CDS sequence (wt) from DENV-4__FJ639736__SS-prME
  source 1..9867: mol_type = other RNA
tcaacgatgacattgttgtgcttgattcccaccgcaatggcgtttcacttgtcaacaagagatggcgaacccctcatgatagtggcaaaacatgaaagagggagacctctcttgtttaagacaacagaggggatcaacaaatgcactctcattgccatggacttgggtgaaatgtgtgaggatactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcctggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaggaacaggaccaacagtacatctgccggagggatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccgtcggtagaagtcaaattgccggactatggagaactaacactagattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacattcaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcatcaggtttttggaagtgtgtatacaaccatgtttggaggagtctcatggatgattagaatcctaattgggttcttagtgttgtggattggtacgaactcaaggaacacttcaatggccatgacatgcatagctgttggaggaatcactctgtttttgggcttcacagttcaagcggacatgggttgtgtggtgtcatggagtgggagagaattgaagtgtggaagcggaatttttgtagttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgttcctgcacaatgccccccttaaggttcttgggagaagatgggtgctggtatgggatggagattaggcccttgagtgaaaaagaagagaacatggttaaatcacaggtgacggccggacagggcacatcggaaactttttctatgggtctgttgtgcctaaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatatgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcgattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaaccgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattgatgaggagaggagaccttccagtgtggctgagctataaggtagcttctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatattggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcctatgctgagacacaccatagaaaacacgtcggccaacctatctctggcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagggaggcccagaaaaggacagctgctggaattatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaacctcgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacctatgagaaggacgtagatcttggggcaggaacgagaagtgtctctactgaaacagaaaaaccagacatgacaatcattgggagaaggcttcagcgattgcaagaagagcacaaagaaacatggcattatgatcaggagaatccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgttaatgacagtcggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctagaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaggtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaatccaaaagggttgaaagaaagagttgagaaatggctgagagagtgtggtgtcgacaggttaaaaaggatggcaatcagtggagacgattgcgtggtgaagcccctagatgagaggtttggcacttccctcctcttcctgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcaccaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 7826 - RNA, 9867 nt, synthetic construct
  misc_feature 1..9867: note = derived and/or modified CDS sequence (wt) from DENV-4__FJ639737__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgttacgtataaatgccccctactgatcaataccgaacctgaagacattgattgctggtgcaacctcacgtctacctgggtcatgtatgggacatgtacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttcttcgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaggaacaggatcaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgactgtgaacccaggtctggaattgactttaatgagatgatcctaatgaaaatgaaaaagaaaacatggctcgtgcacaagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcacgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtgaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatactaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggtaagagagcactcacacccccagtgagtgatctgaaatattcatggaagacatggggaaaagcaaaaatcttcacccctgaagcaagaaatagcacatttttaatagacggaccagacacctctgaatgccccaatgaacgaagagcatggaattctcttgaggtggaagactatggatttggcatgttcactaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgcctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcgtctggaaaactagtcacgcaatggtgttgccgctcctgcacgatgccccccttaaggttcttgggagaagatgggtgctggtatgggatggagattaggcccttgagtgaaaaagaagagaacatggtcaaatcacaggtgacggccggacagggcacatcggaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacgacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcactgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgttatgagtggcagctcagcagatctgtcactagagaaggccgctagtgtgcaatgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatagaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgtccaggtcctcgctatagaaccaggaaaaaatcccaaacatgtccaaacgaaacccggccttttcaagaccctaactggagaaattggagcagtaacattagatttcaaacccggaacgtctggttctcccattatcaacaggaaaggaaaagtcatcggactttatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaattttagggctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacctttgtagaattaatgaggagaggagaccttccggtgtggctgagctataaggtagcttctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccactgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacagaactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccagggcatgaagaaccgattcccatggctacttatggctggaatttggtcaaactccattcaggggttgacgtgttctacaaacccatagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacctatgagaaggacgtagatcttggggcaggaacgagaagtgtctctactgaaacagaaaaaccagacatgacaatcattgggagaaggctccagcgattgcaagaagagcacaaagaaacatggcattatgaccaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgtgaatgacagccggttctgggaactggttgacaaagaaagggcccttcaccaagaagggaaatgtgaatcgtgtgtctacaacatgatgggaaaacgtgagaaaaagttaggagagtttggcagagccaagggaagccgagcaatctggtacatgtggctgggagcgcgatttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctaggaaaaagagaggatttgtggtgcggatccctgattggactttcttctagagccacctgggcgaaaaacattcacacggccataactcaggtcaggaacctgatcggaaaagaggaatacgtggattacatgccagtaatgaaaagatacagtgctccttcagagagtgaaggagttctgtaa

SEQ ID NO: 7827 - RNA, 9867 nt, synthetic construct
  misc_feature 1..9867: note = derived and/or modified CDS sequence (wt) from DENV-4__FJ639738__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgaaaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacctaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgcaaagtccccatagagataagagatgtaaacaaggaaaaagtggttgggcgcgttatctcatccacccctctggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaatcgggttcttagtgttgtggattggcacgaactcaaggaacacttcaatggccatgacgtgcatagctgttggaggaatcactctgtttttgggcttcacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtccgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccggtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacttggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggtccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcttgggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcctgaggagaagagtcactaggaaacacatgatattagctgtggtaatcactctttgtgctatcatcctggggggcctcacatggatggacttgctacgagccctaatcatgttgggggacactatgtctggtagaataggaggacagacccacctagccatcatggcagtgttcaagatgtcaccaggatacgtgctgggtgtgtttttaaggagactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgttcaggtcctcgctgtagaaccaggaaaaaatcccaaacatgtccaaacgaaacctggccttttcaagaccataactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagattgactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagtaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagatatatctgaaatgggggctaattttagagctgggagagtgatagaccctagaagatgcctcaagccagttatcctaacagatgggccagagagagttattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcactggggaaagaaataaccaaattttagaagaaaacatggaggttgaaatttggactagagagggagaaaagaaaaaactgaggccaagatggttggatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaattatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagaggcatggtaaagccaaaagggaaagttgtagatcttggctgtgggagaggaggatggtcttattacatggcgacactcaagaacgtgactgaagtgaaagggtatacaaaaggaggcccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggtttacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctaggcaaagcttacgcccagatgtggtcgcttatgtacttccacagaagggatctgcgtttagcctctatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 7828 - RNA, 9867 nt, synthetic construct
  misc_feature 1..9867: note = derived and/or modified CDS sequence (wt) from DENV-4__FJ639739__SS-prME
  source 1..9867: mol_type = other RNA
tcaacgatgacattgttgtgcttgattcccaccgcaatggcgtttcacttgtcaacaagagatggcgaacccctcatgatagtggcaaaacatgaaagagggagacctctcttgtttaagacaacagaggggatcaacaaatgcactctcattgccatggacttgggtgaaatgtgtgaggatactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcctggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaggaacaggaccaacagtacatctgccggagggatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccgtcggtagaagtcaaattgccggactatggagaactaacactagattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacattcaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcatcaggtttttggaagtgtgtatacaaccatgtttggaggagtctcatggatgattagaatcctaattgggttcttagtgttgtggattggtacgaactcaaggaacacttcaatggccatgacatgcatagctgttggaggaatcactctgtttttgggcttcacagtccaagcggacatgggttgtgtggtgtcatggagtgggagagaattgaagtgtggaagcggaatttttgtagttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcagataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgttcctgcacaatgccccccttaaggttcttgggagaagatgggtgctggtatgggatggagattaggcccttgagtgaaaaagaagagaacatggttaaatcacaggtgacggccggacagggcacatcggaaactttttctatgggtctgttgtgcctaaccttgtttgtggaagaatgcttgaggagaagagtcactaggaaacacatgatattagctgtggtaatcactctttgtgctatcatcctgggaggcctcacatggatggacttgctacgagccctcatcatgttgggggatactatgtctggtagaataggaggacagacccacctagccatcatggcagtgttcaagatgtcaccaggatatgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcgattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctagctggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaaccgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattgatgaggagaggagaccttccagtgtggctgagctataaggtagcttctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatattggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcctatgctgagacacaccatagaaaacacgtcggccaacctatctctggcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagggaggcccagaaaaggacagctgctggaattatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaaattgtagatcttggctgtggaagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcattaaagtccttaacccctacatgccaacagtcatagaagagctggagaaactgcagagaaaacatggtgggaacctcgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacctatgagaaggacgtagatcttggggcaggaacgagaagtgtctctactgaaacagaaaaaccagacatgacaatcattgggagaaggcttcagcgattgcaagaagagcacaaagaaacatggcattatgatcaggagaatccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgttaatgacagtcggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctagaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaggtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaatccaaaagggttgaaagaaagagttgagaaatggctgagagagtgtggtgtcgacaggttaaaaaggatggcaatcagtggagacgattgcgtggtgaagcccctagatgagaggtttggcacttccctcctcttcctgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggcttccaacaagcagaacaacatggtcaatccatgctcaccaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 7829 - RNA, 9867 nt, synthetic construct
  misc_feature 1..9867: note = derived and/or modified CDS sequence (wt) from DENV-4__JN819409__SS-prME
  source 1..9867: mol_type = other RNA
tcaacgataacattgctgtgcttgattcccaccgtaatggcgtttcacttgtcaacaagagatggtgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacggctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatacttagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaggaacaggaccaacagtacatctgccggagagatgtggtagatagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgactttaatgagatgatcctaatgaaaatgaaaaagaaaacatggctcgtgcataagcaatggtttttggatctacctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgtaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccactcctttggctgagaataccaacggtgtaaccaacatagaattagaacccccctttggggacagctacatagtgataggtgttggaaacagcgcattaacactccattggtttaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggtacgaactcgaggaacacttcaatggccatgacgtgcatagctgttggaggaatcactctgtttttgggcttcacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgactaacatatggatgaaattccgggagggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggtccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcttgggagaagatgggtgctggtatgggatggagattaggcccttgagtgaaaaagaagagaacatggttaaatcacaggtgacagccggacagggcacatcggaaactttttctatgggtctgttgtgcctgaccttgtttgtggaagaatgcttgaggagaagagtcactaggaaacacatgatattagctgtgataatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaaccggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaatcggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcctacgagagtggtggcagccgagatggaagaggccctacgcggactgccaatccgttatcagaccccagctgtgaaatcagaacacacaggaagagagattgtagacctcatgtgccatgcaaccttcacaacaagacttttgtcatcaaccagggttccaaattacaaccttatagtaatggatgaagcacatttcaccgatccttccagtgtcgcggctagaggatacatttcgactagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggccaattttagagctgggagagtgatagatcctagaagatgcctcaagccagttatcctaacagatgggccagagagagttattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaacatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatatcttataaagatcgggaatggtgcttcacaggggaaagaaataaccaaattttagaagaaaacatggaggttgaaatttggactagagagggagaaaagaaaaaactgaggccaagatggttagatgctcgtgtatacgctgaccccatggctttgaaggatttcaaggagtttgccagtggaaggaagagtataactcttgacatcctaacagagattgccagtttgccaacttacctttcctctagggccaagctcgcccttgacaacatagtcatgctccacacaacagaaagaggagggagggcctatcaacacgctctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccatcgccaaccaggcagccgtcctaatggggcttggaaaaggatggccactccatagaatggacctcggtgtgccgctgttagcaatgggatgctattcccaagtgaatccaacaaccttgacagcatccttagtcatgcttttagtccactatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaatattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagttgacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcaacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaaaggaagagttcatctcaaaagttagatcaaacgcagccataggcgcagtctttcaggaggaacagggatggacatcagccagtgaagctgtgaatgacagccggttttgggaactggttgacaaagaaagggcccttcaccaagaaggaaaatgtgaatcgtgtgtctataacatgatgggaaaacgtgagaaaaagttaggagagtttggtagagccaagggaagccgagcaatctggtacatgtggctgggagcgcggtttttggaatttgaagccctgggttttttgaatgaagaccactggtttggcagagaaaattcatggagtggagtggaaggggaaggcctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtagtgaaagtcctcagacccacaccgagaggagcggtgatggacatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaatcccaatatgactgacaagactccaatccattcgtgggaagatataccttacctagggaaaagagaggatttgtggtgtggatccctgattggactttcttctagagccacctgggcgaagaacattcacacggccataactcaggtcaggaacctgatcggaaaagaggaatacgtggactacatgccagtaatgaaaagatacagtgctccttcagagagtgaaggagttctgtaa

SEQ ID NO: 7830 - RNA, 9867 nt, synthetic construct
  misc_feature 1..9867: note = derived and/or modified CDS sequence (wt) from DENV-4__FJ639742__SS-prME
  source 1..9867: mol_type = other RNA
tcaacgatgacattgttgtgcttgattcccaccgcaatggcgtttcacttgtcaacaagagatggcgaacccctcatgatagtggcaaaacatgaaagagggagacctctcttgtttaagacaacagaagggatcaacaaatgcactctcattgccatggacttgggtgaaatgtgtgaggatactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcctggcaggatttatggcttatatggttgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaggaacaggaccaacagtacatctgccggagggatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccgtcggtagaagtcaaattgccggactatggagaactaacactagattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacattcaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcatcaggtttttggaagtgtgtacacaaccatgtttggaggagtctcatggatgattagaatcctaattgggttcttagtgttgtggattggtacgaactcaaggaacacttcaatggccatgacatgcatagctgttggaggaatcactctgtttttgggcttcacagttcaagcggacatgggttgtgtggtgtcatggagtgggagagaattgaagtgtggaagcggaatttttgtagttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatactcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgttcctgcacaatgccccccttaaggttcttgggagaagatgggtgctggtatgggatggagattaggcccttgagtgaaaaagaagagaacatggttaaatcacaggtgacggccggacagggcacatcggaaactttttctatgggtctgttgtgcctaaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatatgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtctgcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctagtgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcgattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaaccgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattgatgaggagaggagaccttccagtgtggctgagctataaggtagcttctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatattggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcctatgctgagacacaccatagaaaacacgtcggccaacctatctctggcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagggaggcccagaaaaggacagctgctggaattatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcattaaagtccttaacccctacatgccaacagtcatagaagagctggagaaactgcagagaaaacatggtgggaacctcgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacctatgagaaggacgtagatcttggggcaggaacgagaagtgtctctactgaaacagaaaaaccagacatgacaatcattgggagaaggcttcagcgattgcaagaagagcacaaagaaacatggcattatgatcaggagaatccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgttaatgacagtcggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctagaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaggtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaatccaaaagggttgaaagaaagagttgagaaatggctgagagagtgtggtgtcgacaggttaaaaaggatggcaatcagtggagacgattgcgtggtgaagcccctagatgagaggtttggcacttccctcctcttcctgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcaccaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 7831 - RNA, 9867 nt, synthetic construct
  misc_feature 1..9867: note = derived and/or modified CDS sequence (wt) from DENV-4__FJ639745__SS-prME
  source 1..9867: mol_type = other RNA
tcaacgatgacattgttgtgcttgattcccaccgcaatggcgtttcacttgtcaacaagagatggcgaacccctcatgatagtggcaaaacatgaaagagggagacctctcttgtttaagacaacagaggggatcaacaaatgcactctcattgccatggacttgggtgaaatgtgtgaggatactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcctggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaagaacaggaccaacagtacatctgccggagggatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccgtcggtagaagtcaaattgccggactatggagaactaacactagattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacattcaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcatcaggtttttggaagtgtgtatacaaccatgtttggaggagtctcatggatgattagaatcctaattgggctcttagtgttgtggattggtacgaactcaaggaacacttcaatggccatgacatgcatagctgttggaggaatcactctgtttttgggcttcacagttcaagcggacatgggttgtgtggtgtcatggagtgggagagaattgaagtgtggaagcggaatttttgtagttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttgatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgttcctgcacaatgccccccttaaggttcttgggagaagatgggtgctggtatgggatggagattaggcccttgagtgaaaaagaagagaacatggttaaatcacaggtgacggccggacagggcacatcggaaactttttctatgggtctgttgtgcctaaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatatgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcgattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccatttccccagagcaacagcccaatagaagacatcgagagagagattccggaaaggtcatggaacacagggttcgactggataacagactaccaagggaaaaccgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattgatgaggagaggagaccttccagtgtggctgagctataaggtagcttctgctggcatttcttacaaagatcgggaatggtgcttcactggggaaagaaacaaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatattggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggactttgggttttaccaggtaaaaacagaaaccaccatcctcgatgtggacttgagaccagcttcagcatggacgctctatgcggtagccaccacaattctgactcctatgctgagacacaccatagaaaacacgtcggccaacctatctctggcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaagcaaaagccacaagggaggcccagaaaaggacagctgctggaattatgaaaaatcctacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggaaggcaacccgggaaggttttggaacacgaccatagccgtatccaccgccaacattttcaggggaagttacttggcgggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcattaaagtccttaacccctacatgccaacagtcatagaagagctggagaaactgcagagaaaacatggtgggaacctcgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacctatgagaaggacgtagatcttggggcaggaacgagaagtgtctctactgaaacagaaaaaccagacatgacaatcattgggagaaggcttcagcgattgcaagaagagcacaaagaaacatggcattatgatcaggagaatccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgttaatgacagtcggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctagaatttgaagccctgggttttttgaatgaagatcactggtttggcagagaaaattcatggagtggagtggaaggggaaggcctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaggtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaatccaaaagggttgaaagaaagagttgagaaatggctgagagagtgtggtgtcgacaggttaaaaaggatggcaatcagtggagacgattgcgtggtgaagcccctagatgagaggtttgccacttccctcctcttcctgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcaccaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 7832 - RNA, 9867 nt, synthetic construct
  misc_feature 1..9867: note = derived and/or modified CDS sequence (wt) from DENV-4__FJ850095__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttgagaacctattgcattgaagccttaatatcaaacataactacggcaacaagatgtccaacgcaaggagagccttatctgaaagaggaacaggaccaacagtacatctgccggagagatgtggtagatagaggatggggcaatggctgtggcttgtttggaaaaggaggagttgtgacatgtgcgaagttctcatgctcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtaaccaacatagaactagaacccccttttggggacagctacatagtgataggtgttggaaacagcgcactaacactccattggttcaggaaagggagttccattggcaagatgtttgagtccacatacagaggtgcaaaacgcatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaagggcaagagagcactcacacccccagcgagtgatctgaaatattcatggaagacatggggaaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacattgtggagcaatggagtgctggaaagccagatgctcattccaaaatcatatgcgggccctttttcacagcacaattaccgccagggctatgctacgcaaaccgtgggtccatggcacttaggcaaactagagatagactttggagaatgccccggaacaacagtcacaattcaggaggattgtgaccatagaggcccatctttgaggaccaccactgcatctggaaaactagtcacgcagtggtgttgccgctcctgcacgatgccccccttaaggttcttgggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcactaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggggtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccagtcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagagattggagcagtaacattagatttcaaacctggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgaaatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggaatttgccagtggaaggaagagtataactctcgacatcttaacagagatcgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaattatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaatacgtcggccaacctatctttagcagccatcgccaaccaggcagccgttctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcaggagctggactggctttttcactcataaagaatgcacaaacccccaggaggggaactgggaccacaggagagacactgggagagaagtggaagagacagctaaactcactagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtactgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggatacaagaatcactgaggatgaccttcaaaatgaggaactgatcacggaacagatggctccccaccacaagatcctagccaaagccatcttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaacgacatgggaaaggtgaggaaagatattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaggacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 7833 - RNA, 9867 nt, synthetic construct
  misc_feature 1..9867: note = derived and/or modified CDS sequence (wt) from DENV-4__FJ639748__SS-prME
  source 1..9867: mol_type = other RNA
tcaacgatgacattgttgtgcttgattcccaccgcaatggcgtttcacttgtcaacaagagatggcgaacccctcatgatagtggcaaaacatgaaagagggagacctctcttgtttaagacaacagaggggatcaacaaatgcactctcattgccatggacttgggcgaaatgtgtgaggatactgtcacgtataaatgccccctactggtcaataccgaacctgaagacattgattgctggtgcaacctcacgtctacctgggtcatgtatgggacatgcacccagagcggagaacggagacgagagaagcgctcagtagctttaactccacattcaggaatgggattggaaacaagagctgagacatggatgtcatcggaaggggcttggaagcatgctcagagagtagagagctggatactcagaaacccaggatttgcgctcctggcaggattcatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggagggtgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaagaacaggaccaacagtacatctgccggagggatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccgtcggtagaagtccaattgccggactatggagaactaacactagattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacattcaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgctcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggtagggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcatcaggtttttggaagtgtgtatacaaccatgtttggaggagtctcatggatgattagaatcctaattgggctcttagtgttgtggattggtacgaactcaaggaacacttcaatggccatgacatgcatagctgttggaggaatcactctgtttctgggcttcacagttcaagcggacgtgggttgtgtggtgtcatggagtgggagagaattgaagtgtggaagcggaatttttgtagttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaatgaactaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttgatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgttcctgcacaatgccccccttaaggttcttgggagaagatgggtgctggtatgggatggagattaggcccttgagtgaaaaagaagagaacatggttaaatcacaggtgacggccggacagggcacatcggaaactttttctatgggtctgttgtgcctaaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatatgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcgattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgtacaggtcctcgctatagaaccaggaaaaaatcccaaacatgtccaaacgaaacctggccttttcaaaaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccctaaaaaggaggctgcgaactttgattttggctcccacaagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccatttccccagagcaacagcccaatagaagacatcgagagagagattccggaaaggtcatggaacacagggttcgactggataacagactaccaagggaaaaccgtgtggtttgttcccagcataaaagctggaaatgacattgcaaattgtttgagaaagtcgggaaagaaagttatccagttgagtagaaaaacctttgatacagaatatccaaaaacgaaactcacggactgggactttgtggtcactacagacatatctgaaatgggggctaattttagagctgggagagtgatagaccctagaagatgcctcaagccagttatcctaacagatgggccagagagagtcattttagcaggtcctattccagtaactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattgatgaggagaggagaccttccagtgtggctgagctataaggtagcttctgctggcatttcttacaaagatcgggaatggtgcttcactggggaaagaaacaaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagcttgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatattggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcctatgctgagacacaccatagaaaacacgtcggccaacctatctctagcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaagcaaaagccacaagggaggcccagaaaaggacagctgctggaattatgaaaaatcctacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggaaggcaacccgggaaggttttggaacacgaccatagccgtatccaccgccaacattttcaggggaagttacttggcgggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcattaaagtccttaacccctacatgccaacagtcatagaagagctggagaaactgcagagaaaacatggtgggaacctcgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacctatgagaaggacgtagatcttggggcaggaacgagaagtgtctctactgaaacagaaaaaccagacatgacaatcattgggagaaggcttcagcgattgcaagaagagcacaaagaaacatggcattatgatcaggagaatccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaatcaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgttaatgacagtcggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctagaatttgaagccctgggttttttgaatgaagatcactggtttggcagagaaaattcatggagtggagtggaaggggaaggcctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaggtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaatccaaaagggttgaaagaaagagttgagaaatggctgagagagtgtggtgtcgacaggttaaaaaggatggcaatcagtggagacgattgcgtggtgaagcccctagatgagaggtttgccacttccctcctcttcctgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcaccaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagaatgaaggagttctgtaa

SEQ ID NO: 7834 - RNA, 9867 nt, synthetic construct
  misc_feature 1..9867: note = derived and/or modified CDS sequence (wt) from DENV-4__FJ639764__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggaccaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcctggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgaaaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacctaggtctggaattgactttaatgagatgatcctaatgaaaatgaaaaagaaaacatggctcgtgcataagcaatggtttttggatctgcctcttccatggacagcaggagcagacacatcagaggttcattggaattacaaagagagaatggtgacatttaaggttcctcatgctaagagacaggatgtgacagtgctaggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggcgctggagctccgtgcaaagtccccatagagataagagatgtaaacaaggaaaaagtggttgggcgcgttatctcatccacccctctggctgagaataccaacagtgtaaccaacatagaattagaacccccctttggggacagctacatagtgataggtgttggaaacagcgcattaacactccattggtttaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaatcgggttcttagtgttgtggattggcacgaactcaaggaacacttcaatggccatgacgtgcatagctgttggaggaatcactctgtttttgggcttcacagttcaagcggacatgggttgtgtggtgtcatggagtgggagagaattgaagtgtggaagcggaatttttgtggttgacaacgtgcacacttggatagaacagtacaaattccaaccagagtccccagcgagactagcgtccgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagaacactcacacccccggtgagtgatctgaaatattcatggaagacatggggaaaagcaaaaatcttcacccctgaagcaagaaacagcacatttttaatagatggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacttggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggtccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcttgggagaagatgggtgctggtatgggatggagattaggcccttgagtgaaaaagaagagaacatggtcaaatcacaggtgacggccggacagggcacatcggaaactttttctatgggtctgttgtgcctgaccttgtttgtggaagaatgcctgaggagaagggtcactaggaaacacatgatattagctgtggtaatcactctttgtgctatcatcctggggggcctcacatggatggacttgttacgagccctaatcatgttgggggacactatgtctggtagaataggaggacagacccacctagccatcatggcagtgttcaagatgtcaccaggatatgtgctgggtgtgtttttaaggagactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcgttggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgttcaggtcctcgctgtagaaccaggaaaaaatcccaaacatgtccaaacgaaacctggccttttcaagaccataactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaaggttgactataatggacttacaccccggagctggaaagacaaaaagaattcttccatcaatagtgagagaagccctaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttctgtcatcaaccagggttccaaattacaaccttatagtaatggatgaagcacatttcaccgatccttccagtgtcgcggctagaggatacatttcgaccagggtagaaatgggagaggcagcagccatcttcatgaccgcaacccctcccggagcgacagatccctttccccagagtaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacagactgggactttgtggtcactacagatatatctgaaatgggggctaattttagagctgggagagtgatagaccctagaagatgcctcaagccagttatcctaacagatgggccagagagagttattttagcaggtcctattccagtgactccagcaagcgctgctcagagaagagggcgaatagggaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcactggggaaagaaataaccaaattttagaagaaaacatggaggttgaaatttggactagagagggagaaaagaaaaaactgaggccaagatggttggatgcacgtgtatacgctgaccccatggctttgaaggatttcaaggagtttgccagtggaaggaagagtataactctcgacatcctaacagagattgccagtttgccaacttacctctcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgacgtggacttgagaccagcttcagcatggacgctctatgcggtagccaccacaattctaactcccatgctgagacacaccatagaaaacacgtcggccaacctatctctagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaattatgaaaaatcccacagtggacgggataacagtaatagatctagaaccaatatcctatgacccaaaatttgaaaagcaattagggcaggtcatgctactagttttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagaggcatggtaaaaccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatccaagatgttgttgaacaggtttacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaagccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagacgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctaggcaaagcttacgcccagatgtggtcgcttatgtacttccacagaagggatctgcgtttagcctctatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcatgggaagatataccttatctagggaaaagagaggatttgtggtgtggatccctgattggactttcttctagagccacctgggcgaagaacattcacacggccattactcaggtcaggaacctgatcggaaaagaggaatacgtggattacatgccagtaatgaaaagatacagtgctccttcagagagtgaaggagttctgtaa

SEQ ID NO: 7835 - RNA, 9867 nt, synthetic construct
  misc_feature 1..9867: note = derived and/or modified CDS sequence (wt) from DENV-4__FJ639773__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgtactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatacttagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactactgcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagagattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgtcatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaagggggtgttgaccaagggcaagagagcactcacacccccagcgagtgatctgaaatattcatggaagacatggggaaaagcaaaaatcttcacccctgaagcaagaaacagcacatttttaatagacggaccagacacctctgaatgccccaatgaacgaagagcatggaattcatttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgctacgcaaaccgtgggtccatggcacttaggcaaactagagatagactttggagaatgccccggaacaacagtcacaattcaggaggattgtgatcatagaggcccatctttgaggaccaccactgcatctggaaaactagtcacgcaatggtgttgccgctcctgcacgatgccccccttaaggttcttgggagaagatgggtgctggtatgggatggagattaggcccttgagtgaaaaagaagagaacatggttaaatcacaggtgacggccggacagggcacatcggaaactttttctatgggcctgttatgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgtttaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccagtcacaatgaccttatggtacatgtggcaagtgaaaacacaaagatcaggagccctgtgggacgtcccttcacccgctaccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtaatggatgaagcacatttcaccgatccttccagtgtcgcggctagaggatacatttcgaccagggtggaaatgggagaggcagcagccatcttcatgaccgcaactcctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctgacagagatcgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcctcaattatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggaaaaaacagaaaccaccatcctcgatgtggacttgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggtaacccgggaaggttttggaacacgaccatagccgtatccaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaaaccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggacgtaattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagaatttggcagagccaagggaagccgagcaatctggtacatgtggctgggagcgcggtttctggaatttgaagccctgggttttttgaatgaagatcactggtttggcagagaaaattcatggagtggagtggaaggggaaggtttgcacagattgggatacatcctggaggagatagacaagaaggatggagacctaatgtatgctgatgacacagcaggctgggacacaagaatcactgaggatgaccttcaaaatgaggaattgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggcttgaacacattcaccaacatggaagttcaactcatccgccagatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaacgacatgggaaaggtgaggaaagatatcccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7836 - RNA, 9867 nt, synthetic construct
  misc_feature 1..9867: note = derived and/or modified CDS sequence (wt) from DENV-4__FJ882580__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaaccttacgtccacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaagagtggttgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatctttgtggttgacaacgtgcacacttggacagaacagtacaaattccaaccagagtccccagcgagactagcgtctgcaatattaaatgcccacaaagatggggtctgtggaattagatcaaccacaaggctggaaaatgttatgtggaagcaaataaccaatgagctaaactatgttctctgggaaggaggacatgatctcactatagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttaggcaaactagagatagactttggagaatgccccggaacaacagtcacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggcctgttgtgcctgaccttgtttgtggaagaatgcttgaggagaagagtcaccaggaaacacatgatattagccgtggtaatcactctttgtgctatcatcctggggggcctcacatggatggacttgctacgagccctcatcatgttgggggacactatgtctggtagaataggaggacagacccacctagccatcatggcagtgttcaagatgtcaccgggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgccttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcttgggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgatgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacacaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccttttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagcttgccaacttacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgttattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagttttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaactcatggagtggagtggaaggggaaggtctgcacagattgggatacatcctggaggagatagacaagaaggatggggacctaatgtatgctgatgacacagcaggctgggacacaagaatcactgaggatgatcttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaacgacatgggaaaggtgaggaaagatattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7837 - RNA, 9867 nt, synthetic construct
  misc_feature 1..9867: note = derived and/or modified CDS sequence (wt) from DENV-4__FJ882581__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgttcaagacaacagaggggatcaacaaatgcactctcattgccatggacttgggtgaaatgtgtgaggacactgtcacgtataaatgccccctactggtcaataccgaacctgaagacattgattgttggtgcaacctcacgtctacctgggtcatgtatgggacatgcacccagagcggagaacggagacgagagaagcgctcagtagccttaacaccacattcaggaatgggattggaaacaagagctgagacatggatgtcatcggaaggggcttggaagcatgctcagagagtagagagctggatactcagaaacccaggatttgcactcttggcaggatttatggcttacatgattgggcaaacagggatccagcgaactgtcttctttgtcctaatgatgctggtcgccccatcctacggaatgcgatgcgtaggagtgggaaacagagactttgtggaaggagtctcaggtggagcatgggtcgacctggtgctagaacatggaggatgcgttacaaccatggcccagggaaaaccaaccttggattttgaactaaccaagacaacagccaaggaagtggctctgttaagaacctattgcattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtgaccaacatagaattagaacccccctttggggacagttacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtacaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggaatgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaaaacatgggggaaagcaaaaatcttcacccctgaagcaagaaacagcacatttttaatagacggaccagacacctctgaatgccccaatgaacgaagagcgtggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttaggcaaactagagatagactttggagaatgccccggaacaacagtcacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggctggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaacttattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtggggatacacatggaaggtgtatttcacacaatgtggcatgttacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaaggattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgctcagagaagagggcgaataggaaggaacctagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaagtagcttctgctggcatttcttacaaagatcgggaatggtgcttcactggggagagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgataacatagttatgcttcacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcggccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccacttcacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaagaacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacatttttaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccttggctctcttcaaaacctgaattctgcatcaaagtccttaacccctacatgccaacagtcatagaagagctggaaaaactgcagagaaaacatggtgggaaccttgtcagatgcccgctgtccaggaactccacccatgagatgtattgggtgtcaggagcgtcgggaaacatcgtgagctctgtgaacacaacatcaaagatgttgttgaacaggttcacaacaaggcataggaaacccacttatgagaaggacgtagatcttggggcaggaacgagaagtgtctccactgaaacagaaaaaccagatatgacaatcattgggagaaggcttcagcgattgcaagaagagcacaaagaaacatggcattatgatcaggaaaatccatacagaacctgggcgtatcatggaagctatgaagctccttcgacaggctctgcgtcctccatggtgaacggggtggtgaaactgctaacaaaaccctgggatgtaattccaatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcactagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaactcatggagtggagtggaaggggaaggtctgcatagattgggatacatcctggaggagatagacaagaaggatggagacctaatgtatgctgatgacacagcaggctgggacacaagaatcactgaggatgatcttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttgggacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaacgacatgggaaaggtgaggaaagatattccgcagtgggaaccatctaagggatggaaaaactggcaagaagttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctacgtctagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7838 - RNA, 9867 nt, synthetic construct
  misc_feature 1..9867: note = derived and/or modified CDS sequence (wt) from DENV-4__FJ882582__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagccttaacaccacattcaggaatgggattggaaacaagagctgagacatggatgtcatcggaaggggcttggaagcatgctcagagagtagagagctggatactcagaaacccaggatttgcactcttggcaggatttatggcttacatgattgggcaaacagggatccagcgaactgtcttctttgtcctaatgatgctggtcgccccatcctacggaatgcgatgcgtaggagtgggaaacagggactttgtggaaggagtctcaggtggagcatgggtcgacctggtgctagaacatggaggatgcgttacaaccatggcccagggaaaaccaaccttggattttgaactaaccaagacaacagccaaggaagtggctctgttaagaacctattgcattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgttcgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtgaccaacatagaattagaacccccctttggggacagttacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtacaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggaatgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaaaacatgggggaaagcaaaaatcttcacccctgaagcaagaaacagcacatttttaatagacggaccagacacctctgaatgccccaatgaacgaagagcgtggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgcttattccaaaatcatatgcgggccctttttcacagcacaattaccgccagggctatgctacgcaaaccgtgggtccatggcacttaggcaaactagagatagactttggagaatgccccggaacaacagtcacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggctggacagggcacatcggaaactttttctatgggtctgttatgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtggggatacacatggaaggtgtatttcacacaatgtggcatgttacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaaggattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgctcagagaagagggcgaataggaaggaacctagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaagtagcttctgctggcatttcttacaaagatcgggaatggtgcttcactggggagagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgataacatagttatgcttcacacaacagaaagaggagggagggcctatcaacacgccctgaacgaacttccggagtcactggaaacactcatgcttgtagccttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccacttcacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaagaacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacatttttaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccttggctctcttcaaaacctgaattctgcatcaaagtccttaacccctacatgccaacagtcatagaagagctggaaaaactgcagagaaaacatggtgggaaccttgtcagatgcccgctgtccaggaactccacccatgagatgtattgggtgtcaggagcgtcgggaaacatcgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaatccatacagaacctgggcgtatcatggaagctatgaagctccttcgacaggctctgcgtcctccatggtgaacggggtggtgaaactgctaacaaaaccctgggatgtaattccaatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcactagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaactcatggagtggagtggaaggggaaggtctgcatagattgggatacatcctggaggagatagacaagaaggatggagacctaatgtatgctgatgacacagcaggctgggacacaagaatcactgaggatgatcttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttgggacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaacgacatgggaaaggtgaggaaagatattccgcagtgggaaccatctaagggatggaaaaactggcaagaagttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctacgtctagcctccatggccatatgctcagcagttccaacggaatggtttccaacaagcagaacaacatggtcaatccatgctcatcaccaatggatgaccactgaagacatgctcaaggtatggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgcggattacatgccagtaatgaaaagatacagtgctccttcagagagtgaaggagttctgtaa

SEQ ID NO: 7839 - RNA, 9867 nt, synthetic construct
  misc_feature 1..9867: note = derived and/or modified CDS sequence (wt) from DENV-4__FJ882584__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaaccttacgtccacctgggtcatgtatgggacgtgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcacttttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgaaatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccatacactgtggagcaatggagtgctggaaagccagatgcttattccaaaatcatatgcaggccctttttcacagcacaattaccgccagggctatgctacgcaaaccgtgggtccatggcacttaggcaaactagagatagactttggagaatgccccggaacaacagtcacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggtcaaatcacaggtgacggccggacagggcacatcggaaactttttcaatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccgggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgccgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgatgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacacaagccgaaagaattggagagccagattatgaagtggatgaggacatttttcgaaagaaaagactaactataatggacttacaccccggagccggaaagacaaaaagaattcttccatcaatagtgagagaagccttaaaaaggaggctgcgaactttgattttggctcccacgagagtggtggcggccgagatggaagaggccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgctcagagaagagggcgaataggaaggaacccagcacaagaagacgaccaatacgttttctccggagacccactaaaaaatgatgaagaccatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgctttactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgacaacatagttatgctccacacaacagaaagaggagggagggcctatcaacatgccctgaacgaacttccggagtcactggaaacactcatgcttgtagccttactaggagctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagttttgactttggccacaggaccaatcttgaccttgtgggagggcaacccgggaaggttttggaacacgaccatagccgtatctaccgccaacattttcaggggaagttatttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatctcggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaactcatggagtggagtggaaggggaaggtctgcacagattgggatacatcctggaggagatagacaaaaaggatggagacctaatgtatgctgatgacacagcaggctgggacacaagaatcactgaggatgatcttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggctattagtggagacgattgcgtggtgaaacccctagatgagaggtttggcacttccctcctcttcttgaacgacatgggaaaggtgaggaaagatattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcagaaatctgatcggaaaagaggaatacgtggattacatgccagtaatgaaaagatacagtgctccttcagagagtgaaggagttctgtaa

SEQ ID NO: 7840 - RNA, 9867 nt, synthetic construct
  misc_feature 1..9867: note = derived and/or modified CDS sequence (wt) from DENV-4__FJ882585__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagttggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgtattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtagggaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatatacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttaggcaaactagagatagactttggagaatgccccggaacaacagtcacaattcaggagaactgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagctgtggtaatcactctttgtgctaccatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggtataatggctgtgggtttggtcagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagccataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgatgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgagaaagtcgggaaagaaagtcatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgctcagagaagagggcgaataggaaggaacccagcacaagaagacgaccaatacgttttctccggagacccactaaaaaatgatgaagatcatgcccactggacggaagcgaagatgctgcttgacaatatctacaccccagaagggatcattccaacattgtttggtccggaaagggaaaaaacccaagctattgatggagagtttcgccttagaggggaacaaaggaagacttttgtggaattaatgaggagaggagaccttccggtgtggctgagttataaggtagcttctgctggcatttcctacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtacaactctcgacatcctgacagagatcgccagtttgccaacttacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtggaaaccttgtcagatgcccgctgtccaggaactccacccatgagatgtattgggtgtcaggagcgtcgggaaacattgtgagctccgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagatacaaccccttttgggcaacaaagagtgttcaaagagaaggtggataccagaacgccgcaaccaaaaccaggcacacgaatggttatgaccacgacagccaattggctatgggccctccttggaaagaagaaaaatcccagactgtgcacaaaggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgatcttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgactgcgtggtgaaacccctagatgagaggtttggcacttccctcctcttcttgaacgacatgggaaaggtgaggaaagatattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgactgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7841 - RNA, 9867 nt, synthetic construct
  misc_feature 1..9867: note = derived and/or modified CDS sequence (wt) from DENV-4__FJ882586__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgctgcgtaggagtaggaaacagagactttgtggaaggagtctcaggtggagcatgggtcgacctggtgctagaacatggaggatgcgtcacaaccatggcccagggaaagccaaccttggattttgaactgaccaagacaacagccaaggaagtggctttgctaagaacctattgcattgaagccttaatatcaaacataactacggcaacaagatgtccaacgcaaggagagccttatctgaaagaggaacaggaccaacagtacatttgtcggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtagtgaaagtcaagtatgaaggtgctggagctccgtgtaaagtccccatagagataagagatgtaaacaaggaaaaagtggttgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatctttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgtttaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgattacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtccgaaggagtgtacaggatcatgcaaagagggttattcgggaaaactcaggttggagtagggatacacatggaaggtgtatttcatacaatgtggcatgtcacaagaggatcggtgatttgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaactccagctgtgaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctatcccagtgactccagcaagcgctgcccagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgccttagaggggaacaaaggaagacttttgtggaattaatgaggagaggagatcttccggtgtggctgagttataaggtagcttctgctggcatttcttacaaagatcgggaatggtgtttcactggggaaagaaataaccaaattttagaagaaaacatggaggttgaaatttggactagagagggagaaaagaaaaaactgagaccaaaatggttagatgcacgtgtatacgctgaccccatggctttgaaggatttcaaggagtttgccagtggaaggaagagtataactctcgacatcctaacagagatcgccagtttgccaacctacctttcctctagggccaagctcgcccttgacaacatagttatgcttcacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtggccaccacaattctgactcccatgctgagacacaccatagaaaacacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattccaatggctacttatggctggaatttggtcaaactccattcaggggttgacgtgttctacaaacccacagagcaagtggacaccctgctctgtgatattggggagtcatcttccaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaagacttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagatacaaccccttttgggcaacaaagagtgtttaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaatgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctaggagcgcggtttctggaatttgaagccctgggttttttgaatgaagaccattggtttggcagagaaaactcatggagtggagtggaaggggaaggtctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggacatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaattcatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccatagctcaggtcaggaatctgatcggaaaagaggaatacgtggattacatgccagtaatgaaaagatacagtgctccttcagagagtgaaggagttctgtaa

SEQ ID NO: 7842 - RNA, 9867 nt, synthetic construct
  misc_feature 1..9867: note = derived and/or modified CDS sequence (wt) from DENV-4__JN819406__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaaccttacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgcgagagaattgaagtgtggaagcggaatttttgtggttgacaacgtgcacacttggacagaacagtatcaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccatacactgtggagcaatggagtgttggaaagccagatgcttattccaaaatcatacgcgggccctttttcacagcacaattaccgccagggctatgctacgcaaaccgtgggtccatggcacttaggcaaactagagatagactttggagaatgccccggaacaacagtcacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactctcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgatgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacacaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatctttatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgcttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgctttactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgacaacatagttatgctccacacaacagaaagaggagggagggcctatcaacacgccctgaacgaacttccggagtcactggaaacacttatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgttgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctaggttttttgaatgaagatcactggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgatcttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggctgaaagaaagagttgagaaatggctgagagagtgtggtgtcgacaggttaaagaggatggcaattagtggagacgattgcgtggtgaaacccctagatgagaggtttggcacttccctcctcttcttgaacgacatgggaaaggtgaggaaagatattccgcagtgggaaccatccaagggatggaaaaactggcaagaggttcctttttgctcccaccactttcacaagatctttatgaaggatggccgctcactagtcgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7843 - RNA, 9867 nt, synthetic construct
  misc_feature 1..9867: note = derived and/or modified CDS sequence (wt) from DENV-4__GQ199876__SS-prME
  source 1..9867: mol_type = other RNA
tcaacaataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacttgggtcatgtatgggacatgtacccagagcggagaacggagacgagagaagcgctcagtagctttaacaccacattcaggaatgggattggaaacaagagctgaaacatggatgtcatcggaaggggcttggaaacatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgtattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtagggaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagaggatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccattgagataagagatgtaaacaaggaaaaagtgattgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagctagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttgggcaaactagagatagactttggagaatgccccggaacaacagtcacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaacattttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggcataatggccgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggatgtcccttcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgatgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagactaaccataatggacttacaccccggagctggaaagacaaaaagaattcttccatcaatagtgagagaagccttaaaaaggaggctgcgaactttgattctggctcccacgagagtggtggcggccgagatggaagaggccctacgtggactgccagtccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgctcagagaagagggcgaataggaaggaacccagcacaagaagacgaccaatacgttttctccggagacccactaaaaaatgatgaagatcatgcccactggacggaagcgaagatgttgcttgacaatatctacaccccagaagggatcattccaacattgtttggtccggaaagggaaaaaacccaagctattgatggagagtttcgccttagaggggaacaaaggaagacttttgtggaattaatgaggagaggagaccttccggtgtggctgagttataaggtagcttctgctggcatttcttacaaagatcgggaatggtgcttcactggggaaagaaataaccaaatcttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgacaacatagttatgctccacacaacagaaagaggagggagggcctatcaacacgccctgaacgaacttccggagtcactggaaacactcatgcttgtagccttattaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccggaaaaacaaaggaccccacaagacaatcaattgatctacgtcatattgaccattctcaccattattggtctaatagcagccaacgagatggggctgatagaaaaaacaaaaacggattttgggttctaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccctgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacatcttcagaggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaaggatatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttccaatccaacaatagaggaaggaagaacattaagagttttgaagatggtggagccatggctctcttcaaaacctgaattctgcatcaaagtccttaacccctacatgccaacagttatagaagagctggagaaactgcagagaaaacatggtgggaaccttgtcagatgcccgctgtccaggaactccacccacgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaagctgctaacaaaaccctgggatgtaattccaatggtgactcagttagccatgacagatacaaccccttttgggcaacaaagagtgttcaaagagaaggtggataccagaacaccgcaaccaaaaccaggcacacgaatggttatgactacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctaggagcgcggtttctggaatttgaagccctgggttttttgaatgaagatcactggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgatcttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccagaaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgactgcgtggtgaaacccctagatgagaggtttggcacttccctcctcttcttgaacgacatgggaaaggtgaggaaagatattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgactgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7844 - RNA, 9867 nt, synthetic construct
  misc_feature 1..9867: note = derived and/or modified CDS sequence (wt) from DENV-4__KP723482__SS-prME
  source 1..9867: mol_type = other RNA
tcaacaatgacattgctgtgtttgattcccaccgtaatggcgtttcacctgtcaacaagagatggcgaacccctcatgatagtggcaaaacacgaaagggggagacctctcttgttcaagacaacagaaggaatcaacaaatgcaccctcattgccatggacctgggtgaaatgtgtgaagacactgtcacgtataaatgtcctctactggtcaacaccgaacctgaagacattgattgctggtgcaatctcacgtccacctgggtcatgtacgggacatgtacccagagcggagaacggaggcgagaaaagcgctcagtagctttaacaccacattcaggaatgggattggaaacaagagctgagacatggatgtcatcggaaggggcctggaaacatgctcagagagtggaaagctggatactcagaaacccaggatttgcgctcctggcaggatttatggcttatatgattgggcaaacaggaatccagcgaactgtcttctttgtcctaatgatgctagtcgccccatcctacggaatgcgatgcgtaggggtagggaacagagactttgtggaaggagtctcgggtggagcatgggtcgacttggtgctagaacatggaggatgcgtcacaaccatggcccagggaaaaccaaccttggattttgaactgaccaagacaacagctaaagaagtggctctgttaagaacctattgcattgaagcttcgatatcgaacataaccacggcaacaagatgtccaacgcaaggagagccttatctcaaagaggaacaagaccagcagtacatttgccggagagatgtagtagatagagggtggggcaatggttgtggcttgtttggaaaaggaggagttgtgacatgtgcgaagtttttatgctcggggaagataacaggcaatctggtccaaattgaaaaccttgaatatacggtagttgtgacagtccacaatggaaacacccatgcagtaggaaatgacacatctaatcatggagtgacagccacgataactcccaggtcaccatcggtagaagtcaaattgccggactatggagaactaacacttgattgtgaacccaggtccggaattgacttcaatgagatgatcctgatgaaaatgaaaaagaaaacgtggcttgtgcacaagcaatggtttttggacctacctctaccatggacagcaggagcagacacatcagaagttcattggaattataaagagagaatggtgacattcaaagttcctcatgccaagagacaggatgtgacagtgctaggatctcaggagggagccatgcattctgccctcgccggagccacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtacgaaggcgctggagctccgtgtaaagttcccatagagataagagatgtgaacaaggaaaaagtagttgggcgcatcatctcatctaccccttttgctgagaataccaacagcgtaaccaacatagaattagaacccccttttggggacagctacatagtgataggtgttggagatagtgcattaacactccattggttcaggaaagggagctccattggcaagatgtttgagtccacatacagaggtgcaaaacgaatggccattctaggtgaaacagcttgggattttggttctgttggtggactgttcacatcactgggaaaggctgtacaccaagtttttggaagtgtgtatacaaccatgtttggaggggtctcatggatgattagaattctaattgggttcttagtattgtggattggcacgaattcaagaaatacttcaatggcaatgacgtgcatagctgttgggggaatcactctgtttctaggtttcacagttcaagcagacatgggttgtgtggtgtcatggaatgggaaggaactaaaatgtggaagcggaatctttgtggttgacaacgtgcacacttggacagaacagtacaaattccaaccagagtccccagcgaggctagcgtctgcaatattgaatgcccacaaagatggggtctgtggaatcagatcaaccacgaggctggaaaatgtcatgtggaagcaaataaccaacgagctaaactatgttctctgggaaggaggacatgacctcacagtagtggctggggacgtgaaaggggtgttgaccaaaggcaagagagcactcacacctccagtgaatgatctgaaatattcatggaagacatggggaaaagcaaaaatctttaccccagaagcaagaaatagcacatttttaatagacggaccagatacctccgaatgccccaatgaacgaagagcatggaacttttttgaggtagaagactatggatttggcatgtttacgaccaacatatggatgaaattccgagaaggaagttcagaagtgtgtgaccatagattaatgtcggcggcaattaaagatcagaaagctgtgcatgctgacatgggttattggatagagagctcaaaaaaccagacctggcaaatagagaaagcatcccttattgaagtgaaaacatgcctgtggcccaaaacccacacgttgtggagcaatggagtgctggaaagtcagatgctcattccaagatcatatgcaggccctttttcacagcacaattaccgccagggctatgccacgcaaaccgcgggcccatggcacttgggcaaattggagatagactttggagaatgtcccggaacaacagtcacaattcaggaggattgtgaccatagaggcccatctttgaggaccaccactgcatctggaaaactagtcacgcagtggtgctgccgctcctgcacgatgccccccttaaggttcttgggagaagatggatgctggtacgggatggagattaggcccttgagtgaaaaagaagagaacatggtcaaatcacaggtaacagccggacagggtacatcagaaactttttctatggggctgctatgcctgaccttgttcgtggaagaatgcttaaggagaagagtcactaggaaacacatgatattggctgtggtaatcaccttctgtgctatcatcctaggaggtctcacatggatggacttactacgagtccttatcatgttaggggacactatgtctggtagaataggaggacagattcacctagccatcatggcagtgttcaagatgtcaccaggatatgtgctgggtgtgtttttaaggaaacttacttcaagagagacagcgttaatggtaataggaatggccatgacaacggtgttttcaattccacatgatctcatggaactcattgatggaatatcattggggttgatattactaaaaatagtaacacactttgataacacccaagtgggaactttagccctttccctgactttcataagatcaacaacaccattagtcatggcttggaggaccatcatggctgtgttctttgtggtcacactcattcctttgtgcaggacaagctgtcttcaaaaacagtcccattgggtagaaataacagcacttatcttaggagcccaggctttgccagtgtacctaatgactctcatgaaaggagcctcaagaagatcttggcctctcaatgagggcataatggctgtgggtctggtgagcctcttaggaagcgccctcttaaagaatgatgttcctttagctggcccaatggtggcaggaggcttacttctagcggcttacgtaatgagtggtagctcagcagacctgtcactagagaaggctgccaatgtgcaatgggatgaaatggcggacataactggctcaagcccgatcatagaagtgaagcaggatgaagatggctctttctccatacgggacgtcgaggaaaccaacatgataaccctcttggtgaaactagcgctgataacagtatcaggtctttaccccttggcaattccagttacaatggcactatggtatgtttggcaagtgaaaacacaaagatcaggagctctgtgggacgtcccctcaccctctgccactcagaaagccacactgtctgaaggggtgtataggattatgcaaagagggttgttcgggaaaactcaggttggagtggggatacacatggaaggtgtattccacacaatgtggcacgtaacaagaggatcagtgatctgccatgagacagggagattagagccatcttgggctgacgtcaggaatgacatgatatcatacggtgggggatggaggctcggagacaagtgggacaaagaagaagatgttcaggtcctagccatagaaccaggaaaaaatcctaaacatgtccaaacgaaaccaggccttttcaagaccttaactggagaaattggagcagtaactctggatttcaaacccggaacgtctggctctcctatcataaacaagaaagggaaagttattggactctatggaaatggagtagttaccaaatcaggtgattacgtcagtgccataacgcaagccgaaagaattggtgagccagattatgaagtggatgaggacatcttccgaaagaaaagattaaccataatggacttacaccccggagccgggaaaacaaaaagaattctcccatcaatagtcagagaagctttgaaaaggaggctgcgaaccttgattctggcccccacgagagtggtggcggccgagatggaagaggccttacgcggactgccaatccgttatcagaccccagctgtgaaatcagagcacacaggaagagagattgtagacctcatgtgtcatgcaaccttcacaacgagacttttgtcatcaaccagggttccaaattataacctcatagtgatggatgaagcacattttactgacccttgtagtgtcgcagctagaggatacatctcaaccagggtggaaatgggagaggcagcagctatcttcatgactgcaacccctcctggatcgatagatcccttcccccagagcaacagcccaatagaagacatcgagagggaaatcccagaaaggtcatggaacacagggttcgactggataacagactaccaagggaaaacggtgtggtttgttcccagcataaaagctggaaatgacattgcaaattgtttgagaaagtcgggaaagagagtgatccagttgagcagaaaaacctttgacacagagtatccaaagacgaaactcacggactgggattttgtggtcaccacagacatatctgaaatgggagccaatttcagagctgggagagtgatagaccccaggagatgcctcaagccagttatcctgacagatgggccagagagagttattctagcaggtccaattccagtaactccagcaagtgccgctcagaggagagggcgaataggtaggaatccagcacaagaagatgaccaatatgttttctccggagacccactaaagaatgatgaagatcatgctcactggacagaagcaaagatgttgcttgacaatatctacactcctgaagggataattccaacattgtttggtccggaaagggaaaaaacccaagctattgatggagagtttcgcctcagaggggaacaaaggaagacttttgtggaattgatgaggagaggagaccttccggtgtggctgagctacaaggtagcttctgccggtatatcttacaaagaccgagaatggtgcttcacaggggaaaggaataaccaaattttagaagaaaacatggaggttgaaatatggactagagagggagaaaagaaaaagctaaggccaaaatggttagatgcacgtgtgtacgctgaccccatggctttgaaggatttcaaggagtttgccagtggaagaaagagcataactcttgacatcctaacagagattgccactttgccaacttacctttcctctaaggccaagctagcccttgacaacatagtcatgctccacacaacagaaaaaggagggagggcctaccaacatgccctgaacgaactcccggagtcactggaaacactcatgcttgtagccctactaggtgctatgacagccggtatcttcctgtttttcatgcaggggaaaggaatagggaaattgtcaatgggtctgatagccatagctgtggctagtggcttgctctgggtagcagaaattcagccccagtggatagcagcttcaatcatactggagttttttcttatggtgctgttgataccagaaccagaaaaacaaaggaccccacaagacaatcaattgatctacgttatattgaccattctcaccattattggtcttatagcagccaatgagatggggctgattgaaaaaacaaaaacggactttgggttctaccaggtaaaaccagaaaccaccattcttgatgtggatttgagaccagcctcagcgtggacactctatgcagtggccaccactattctgactcccatgctgagacacaccatagagaacacgtctgccaacctatctctagcagccattgccaaccaagcagctgtcctaatgggacttggaaaaggatggccgctccacaggatggatctcggtgtgccgctgctagcaatgggatgctattctcaagtgaacccaacaaccttgacagcatccctagttatgctcttagttcattatgccataataggtccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaagtcatgctactagtcctgtgtgttggacaattacttttgatgagaacaacatgggctctctgcgaagtactgactctggccacaggaccagtcatgaccttgtgggagggcaacccgggaaggttttggaacacaaccatagctgtatccacagctaacatttttagaggaagctacttggcgggagctggactagctttctcgctcataaagaatgcacaaacccctaggaggggaactgggaccacaggagagacactgggagagaagtggaagagacagctaaactcattagacagaaaagagtttgaagagtacaaaagaagtggaatactagaagtggataggactgaagccaagtctgccctaagagatggaaccaaaatcaagtatgcggtgtccagagggtctagtaagatcagatggattgttgaaagaggaatgataaaaccaaaaggaaaggtcgtagatcttggttgcgggaggggaggatggtcctattacatggcgacgctcaagaacgtgactgaagtgaaaggatatactaaaggaggtccaggacacgaagaaccaatccccatggctacctatggctggaatttggtcaaactccattcaggagttgatgtgttctacaaacccacagagcaggtggacaccctgctttgtgacattggggagtcatcctctaatccgacaatagaagaaggaagaacattgagagtcttgaagatggtggagccatggctctcttcaaaacctgagttctgcataaaagtcctcaacccctacatgccgacagttatagaagagctggagaaactgcagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacagtcattgggagaaggcttcagagattgcgagaagagcacaaagaaacctggcactatgaccaggaaaacccatacagaacctgggcgtatcatggaagctatgaagctccttcgacaggctcagcatcctccatggtgaacggggtagtaaaactgctgacaaaaccttgggatgtgattccaatggtgactcagttggccatgacagacacaaccccttttgggcaacaaagagtgttcaaggagaaggtggataccagaacaccacaaccaaaacccggcacacggatgattatgaccacgacagccaattggttgtgggccctcctcgggaagaagaaaagccctagactgtgcacaagggaagagttcatctcaaaagttaggtcaaatgcagccataggcgcagtcttccaggaagaacagggatggacatcagccagtgaagctgtgaatgacagccggttctgggaactggttgacaaagaaagggctctgcaccaggaaggaaaatgtgaatcgtgcgtctacaacatgatgggaaagcgtgagaaaaaattaggagagtttggtagggccaagggaagccgagcaatctggtacatgtggctgggggcgcggttcctggaatttgaagccctgggttttttgaatgaagatcactggtttagcagagaaaactcatggagtggagtggaaggggaaggtctgcacagattgggatacatcttggaggacatagacaagaaggatggagacctgatatatgctgacgacacagcaggctgggacacgaggatcactgaagatgaccttttaaatgaagaactgatcacagaacagatggcccctcaccacaagaccctagccaaagccattttcaaactaacctatcaaaacaaagtggtgaaagttctcagacccacaccgaaaggagcggtaatggacattatatccaggaaagaccaaagaggtagtggacaggttggaacatatggtttaaacacattcactaacatggaagtccaactcatccgccaaatggaagctgaaggagtcatcacacaagacgacatgcagaacccaaaagggttgaaagaaagagtcgagaaatggctgaaagagtgtggcgtcgacaggttgaagaggatggcaatcagtggagatgattgcgtggtgaagcccttagatgagaggtttagcacctccctcctcttcttgaatgacatgggaaaggtgaggaaagatatcccgcagtgggaaccatccaagggatggaaaaactggcaagaggttcctttttgctcccaccatttccacaagatcttcatgaaagatggccgctcactagttgttccatgcagaaaccaggatgaactgataggaagagccagaatctcgcagggggctggatggagcttgagagagacagcctgtctgggcaaagcttacgcccaaatgtggtcgcttatgtatttccatagaagggacctgcgcctagcctccatggccatatgctcagcagttccaacagaatggtttccaacaagcagaacaacatggtcaatccacgctcatcaccagtggatgaccactgaagatatgcttaaagtgtggaacagagtgtggatagaagataaccccaatatgactgacaagactccagtccattcgtgggaagacataccttacctagggaaaagagaggatctgtggtgcggatccctgattggactttcttccagagccacctgggcgaagaatattcacacggctataacccaggtcaggaatctgatcggaaaagaggaatatgtggattacatgccagccatgaaaagatacagcgctcctttcgagagtgaaggagttctgtaa

SEQ ID NO: 7845 - RNA, 9867 nt, synthetic construct
  misc_feature 1..9867: note = derived and/or modified CDS sequence (wt) from DENV-4__JN638570__SS-prME
  source 1..9867: mol_type = other RNA
tcaacaataacactgctgtgcttgattcccactgtaatggcgtttcacttgtcaacgagagatggtgaacccctcatgatagtggcgaaacacgaaagggggagacctctcttgtttaagacaacagaaggaatcaataagtgcactcttattgccatggacctgggtgagatgtgcgaggacaccgtcacgtataaatgccccttactggtcaataccgaacccgaagacattgattgctggtgcaatctcacgtctgcctgggttatgtatgggacatgcacccaaagtggagaacgaaggcgagagaagcgctcagtagctctaacaccacattcaggaatgggattggaaacaagggctgaaacatggatgtcatcggaaggagcctggaaacacgcccagagggtagagagttggatactcagaaacccaggattcgcgctcttggcagggtttatggcatacatgatcgggcaaacaggaatccagcgaacagtcttcttcattctaatgatgttggtcgccccatcttacggaatgcgatgcgtaggagtagggaacagagactttgtagaaggagtctcaggtggagcatgggtcgatctggtgctagaacatggaggatgtgtcactaccatggcccagggaaagccaactttggattttgaactgatcaagacaacagccaaggaagtggccctgttaagaacctattgcattgaagcttccatatcaaacataaccacagcaacaagatgtccaacgcaaggagagccttacctcaaagaggaacaagatcaacagtacatttgccggagagacatggtagatagagggtggggcaacggctgtggcttgtttgggaagggaggagttgtgacatgtgcgaagttttcatgcttggggaagataacgggcaacttagtccaaattgagaaccttgaatacacagtggttgtaacagtccacaatggagacactcacgctgtaggaaatgacacatctaaccatggagtgacagccacgataactcccaggtcaccatcggttgaagttaaattaccggactatggagaattgacacttgactgtgaacctagatccggaattgactttaatgagatgattctgatgaaaatgaaaacgaaaacgtggctcgtgcacaagcaatggtttttggatctacctctaccatggacaacaggagcagacacgctagaagttcactggaatcacaaagagagaatggtgacatttaaggttcctcatgccaagagacaggatgtgacagtgctaggatctcaggaaggagccatgcattcagccctcgccggagccacagaagtggattccggtgatggaaaccatatgtttgcaggacacttaaagtgtaaagttcgtatggaaaagttgaggatcaagggaatgtcatacacgatgtgctcaggaaagttctcaattgataaagagatggcagaaacacagcatggaacaacagtggtaaaggtcaagtatgagggtactggagctccatgtaaagttcccatagagataagagatgtgaacaaggaaaaagtggttgggcgcattatctcatccaccccttttgctgagaataccaacagtgtgaccaacatagaattggaacctccttttggggatagttacatagtgataggtgtgggagacggtgcattaacactccattggttcaggaaagggagctccattggcaagatgtttgagtccacatacagaggtgcaaagcgcatggccattctaggtgaaacagcttgggattttggttccgttggtggactgctcacgtcattaggaaaggctgtacaccaggtttttggcagtgtgtacacaactatgtttggaggagtctcatggatggtcagaatcctaatcgggctcttagtgttgtggattggtacgaattcaagaaacacttcaatggctatgtcgtgcatagctgttggaggaatcaccctgtttctgggcttcacagtccatgcagacatgggttgtgtggtgtcatggagtgggaaagagttgaaatgtggaagcggaatttttgtaattgacaacgtgcacacttggacagaacagtacaaatttcaaccagagtctccagcgcgactggcgtcggcaatactgaatgcccacaaagaaggggtctgtggaattagatcaaccacaaggctggaaaatgtcatgtggaaacaaataactaatgagttaaactatgttctctgggaaggaggacatgacctcactgtagtggccggggatgtgaaaggggtgttgtccaaaggcaagagagcactcgcacctccagtgaatgacctgaaatattcatggaagacatgggggaaagcaaagatctttactccagaaacaagaaacagcacatttttggtggacggaccagacacctccgaatgccccaatgaacgaagagcatggaactttcttgaggtggaagactatggatttggcatgttcacgaccaacatatggatgaaatttcgagaaggaagtccagaagtgtgtgaccataggctgatgtcagcagcaatcaaagaccagaaagctgtgcatgctgatatgggctattggatagagagctcaaaaaaccagacctggcagatagagaaggcatccctcatagaagtgaaaacatgtctgtggcccaagacccacacattgtggagcaatggagtgctggaaagccagatgctcatcccaaaagcatatgcaggccctatctcacagcacaactatcgccaaggctatgccacgcagaccgcgggcccatggcacttgggcaaattggaaatagactttggagaatgccccggaacaacagtcactgtacaagaggattgtgaccatagaggcccatctttgaggaccaccactgcatctggaaaattggtcacgcagtggtgctgtcgctcctgcacgatgcctcccttaagatttttaggagaggatggatgctggtatgggatggaaatcaggcccttgaatgaaaaagaagagaacatggtcaaatcacaggtttcagccggacagggtacatcagagactttttctatggggctgttgtgcctgactttgtttgtggaagaatgcttgaggagaagagtcaccaggaaacacatgatgttggttgtggtgaccaccctttgtgccatcattttaggaggtcttacatggatggacttactgcgtgccctcatcatgctaggggacaccatgtctggtagaatggggggacaaattcatctagccatcatggcagtgttcaagatgtcaccaggatacgtgttgggtatatttctgaggaaactcacctcaagagagacagcactgatggtaataggaatggccatgacaacggtgcttgcaattccacatgaccttatggaatttattgatggaatatcattagggttaattttattaaaaatggtaacacattttgacaacactcaagtgggaaccttagcccttgccttaaccttcataaaatcaacaatgccattggtcatggcttggaggaccataatggctgtgttgtttgtggtcacactcattcctctatgtaggacaagctgtcttcaaaagcagtcccattgggtggaaataacagcactcatcctgggagcccaggctctgccagtatacctaatgactctcatgaaaggagcctcaaaaagatcttggccccttaacgagggtataatggctgtgggcttggtcagtctcttaggaagcgccctcctaaagaatgatgtccctttagctggcccaatggtggcaggaggtttacttctggcagcctacgtgatgagcggcagctcagcagacctgtcactagagaaggctgccaatgtgcggtgggatgagatggcagacataacaggctcaagcccaatcatagaagtgaagcaggatgaagatggctctttctccatacgggacgtcgaggaaaccaacatgattaccctcctggtgaaactggcactgataacagtgtcaggtctctaccccttggcaattccagtcacaatgaccttatggtacatgtggcaagtgaaaacacaaagatcaggagccctgtgggacgtcccctcacctgctgccgctcagaaagctacactgactgagggagtatacaggatcatgcaaagagggttgtttgggaaaacccaggttggagtagggatacacacggaaggtgtgtttcatacaatgtggcatgtaacaagaggatcagtaatttgccatgagagtgggagactggagccatcttgggctgacgtcaggaacgacatgatatcatatggtgggggatggaggctcggagacaaatgggataaagaagaagatgttcaagttctagctatagaaccaggaaaaaatccgaaacatgtccaaacgaaacccggcctcttcaaaacccttactggagaaattggagcagtaacattggacttcaaacccggaacatccggttcccccatcattaacaggaaaggaaaagtcatcggactctacggaaatggggtagttaccaaatcaggtgattacgttagtgccataacacaagctgaaagaattggtgagccagactatgaagtggatgaggacattttccgaaagaaaagattaaccataatggatttacatcccggagccggaaagacaaaaagaatcctcccatcaatagttagagaagccttaaaaaggaggctgcgaaccttgattctggctcccacgagagtggtggcggccgaaatggaagaagcgctacgtggactgccaatccgttatcagaccccagctgtgaaatcagaacacacaggaagagagatcgtagacctcatgtgtcatgcaacctttacaacaagacttttatcatcgaccagggttccaaattacaacctcatagtgatggatgaagcgcatttcacagacccttctagtgttgcagctagaggatatatctcaaccagggtggaaatgggagaggctgcagctatctttatgactgcaacccctcctggaacgacagatcccttcccccagagcaacagcccaatagaagacatcgagagagaaatcccagaaaggtcatggaacacagggtttgactggataacggactaccaagggaagactgtgtggtttgttcccagcataaaagctggaaatgacattgcaaattgcttgagaaaatcgggaaagaaggtcatccaattgagcaggaaaaccttcgatacagagtatccaaaaacgaaactcacggactgggattttgtggttaccacagacatatctgaaatgggggccaattttagagctgggagagtgatagaccccaggagatgcctcaagccagttatcttaactgatgggccagagagagttattttagctggtcccattccagtgactccagcaagcgctgctcagagaagagggcgaataggtaggaacccagcacaagaagatgaccagtatgtcttctccggagacccactaaggaatgatgaagatcatgcccactggactgaagcaaagatgcttcttgataatatctacaccccagaagggatcattccaacactgtttggtccagaaagggaaaaaacccaagccattgatggagagttccgcctcagaggggagcaaaggaagacctttgtagaattaatgaggagaggagaccttccggtgtggctgagctacaaggtagcttctgctggtatctcttacaaagaccgggaatggtgctttacgggggaaaggaataaccaaattctggaagaaaacatggaggttgaaatttggactagagagggagagaagaaaaaactcaggccaaaatggttagatgcacgtgtttacgctgatcccatggctctgaaggatttcaaggagtttgccagtggaagaaagagcataaccctcgacatcttgacagaaattgccagtttgccaacgtacctttcctccagggctaagctcgcccttgacaacatagtcatgctccatacaacagaaagaggagggaaggcctaccaacacgctctgaacgaactcccagagtcactagaaacactcatgcttgtagctttattaggagccatgacagcaggcatcttcctattcttcatgcaaggaaaaggaataggaaaattgtcaatgggtttgatagccattgcggtagctagtggcttactctgggtggcagaaatccagccccaatggatagcggcctcaatcatattggagttttttctcatggtgttgttggtaccagaaccagaaaaacaaaggaccccacaagacaatcaattgatctacgtcatattgaccattcttactattattgctctcgtggcagccaatgagatggggctaattgaaaaaacaaaaacggattttgggttttaccaggtgaaagcagaaaccaccatccttgatgtggacttgagaccagcttcagcatggacgctctatgcagtagctaccactatcttgactcccatgctgaggcacaccatagaaaacacgtctgcaaacttatccttggctgccattgccaaccaagcagccgtcctgatggggcttggaaaaggatggccgctccacagaatggacctcggtgtgccgcttttggcaatgggatgctattcccaagtgaacccaacaactttaacagcatccttagtcatgcttctggtccattatgcaataataggtccaggattgcaggccaaagccacaagagaggctcaaaaaaggacagctgctgggatcatgaagaaccccacggtggacgggataacagttatagatctagaaccaatatcctatgacccaaaatttgagaagcagctggggcaagtcatgctactagttctgtgcgctggacagctactcttgatgagaacaacatgggccttttgtgaagtcttgactctggccacaggaccaatcttgaccttgtgggaaggcaacccgggaaggttttggaacacgacaatagccgtgtccactgccaacattttcaggggaagctacttggcgggagctggattggccttttcgctcataaagaatgcacaaacccccaggaggggaactgggaccacaggagagacactgggagaaaaatggaagagacagctaaactcgctagataggaaggagtttgaagagtacaaaagaagtggaatactagaagtggacaggactgaagccaagtctgccctaaaagatgggtccaaaatcaagtacgcagtgtccagaggtaccagcaagatcagatggattgttgaaagagggatggtaaagccaaaagggaaagttgtggatcttggttgcggaaggggaggatggtcgtactatatggcgacactcaagaacgtgaccgaggtgaaagggtatacaaaaggaggtccaggacatgaggaaccgattcccatggctacctatggctggaacttggtcaaactccattcaggggttgacgtgttctacaaacccactgagcaagtggacactttgctctgtgatattggggagtcatcctctaatccgacgatagaggaaggaagaacattacgagttttaaagatggtggagccatggctctcttcaaaacctgaattctgcatcaaagtcctcaatccctacatgccaacagtcatagaggagctggagaaactgcagagacgatatggtggaagtcttgtcagatgcccgctatccaggaattccactcatgagatgtattgggtgtcgggtgtgtcaggaaacatcgtgagttctgtgaacacaacatcaaagatgttgttgaacagatttaccacaaggcacaggaaacccacttatgagagggacgcagaccttggagcaggaacgagaagtgtctccaccgaaacagaaaaaccagacatgacaatcatcgggagaagactccagcgattgcaagaagagcacaaagaaacttggcactatgatcatgaaaatccatacagaacctgggcgtatcatggaagctatgaagctccctcgacaggctcagcatcttccatggtgaacggggtagttaaactgctgacaaaaccctgggacgtggttccaatggtgactcagttggctatgacagatacgaccccctttgggcaacagagagtgttcaaggagaaggttgacaccagaacaccacagccaaaacccggtacacgagtagtcatgaccacgacagccaactggctgtggactctcctcgggaggaagaaaaatcccagactgtgcacaagggaagaattcatctcaaaagttaggtcaaacgcagccataggcgcagtctttcaggaagaacagggatggacatcagccagtgaggcagtgaatgacagccggttttgggaactggttgacaaagaaagggctttacaccaggaagggaaatgtgaatcatgtgtctataacatgatgggaaaacgtgaaaaaaaattaggagaatttggcagagccaagggaagccgagcaatctggtacatgtggctgggagcgcggtttctggaatttgaagccctgggctttttgaatgaagatcactggtttggcagagaaaactcatggagtggagtggaaggggaaggtctgcataggttgggatacatcttggaggacatagacaagaaggatggagatttgatatatgctgatgacacagcaggctgggacacaagaatcactgaagatgaccttctgaatgaagagctgatcacggaacagatggcccctcatcataaaatcctagctaaagccattttcaaactaacttatcaaaacaaagtggtaaaagtcctcagacccacaccgaaaggagcagtgatggacattatatccaggaaagatcaaagaggtagtggacaggttggaacatatggtttgaacacattcaccaacatggaagtgcaactcatccgccaaatggaagctgaaggagtcattacacgagatgacatgcataacccaaaagggttgaaagaaagagttgagaaatggctgaaagagtgtggtgtcgacaggttaaagaggatggcaattagtggagacgattgtgtggtgaagcctctagatgagaggttcagcacttccctcctctttttgaacgacatgggaaaggtgaggaaagacattccgcaatgggaaccatccaagggatggaaaaactggcaagaggttcctttttgctcccaccattttcacaagatctttatgaaggatggccgttcactggtcgttccatgtagaaaccaggatgaactaatagggagagccagaatctcgcaaggggctggatggagtttaagagaaacggcctgtctgggcaaagcttacgcccagatgtggtcgctcatgtactttcatagaagggacctacgtttagcctccatggctatatgctcagcagtcccaacggaatggtttccaacaagcagaacaacatggtcaatccacgctcatcatcagtggatgactactgaagatatgctaaaagtgtggaacagagtgtggatagaagacaaccctaacatgattgacaaaactccagttcactcgtgggaagatataccttacctagggaaaagagaggatttgtggtgtggatccttgattggactctcttctagggccacctgggccaagaacattcacacagccataacccaggtcaggaacctgatcgggaaagaggaatatgtggattacatgccagccatgagaagatacagcgctcatttcgagagtgaaggagttctgtaa

SEQ ID NO: 7846 - RNA, 9867 nt, synthetic construct
  misc_feature 1..9867: note = derived and/or modified CDS sequence (wt) from DENV-4__JN638571__SS-prME
  source 1..9867: mol_type = other RNA
tcaacaataacactgctgtgcttgattcccactgtaatggcgtttcacttgtcaacgagagatggtgaacccctcatgatagtggcgaaacacgaaagggggagacctctcttgtttaagacaacagaaggaatcaataagtgcactcttattgccatggacctgggtgagatgtgcgaggacaccgtcacgtataaatgccccttactggtcaataccgaacccgaagacattgattgctggtgcaatctcacgtctgcctgggttatgtatgggacatgcacccaaagtggagaacgaaggcgagagaagcgctcagtagctctaacaccacattcaggaatgggattggaaacaagggctgaaacatggatgtcatcggaaggagcctggaaacacgcccagagggtagagagttggatactcagaaacccaggattcgcgctcttggcagggtttatggcatacatgatcgggcaaacaggaatccagcgaacagtcttcttcattctaatgatgttggtcgccccatcttacggaatgcgatgcgtaggagtagggaacagagactttgtagaaggagtctcaggtggagcatgggtcgatctggtgctagaacatggaggatgtgtcactaccatggcccagggaaagccaactttggattttgaactgatcaagacaacagccaaggaagtggccctgttaagaacctattgcattgaagcttccatatcaaacataaccacagcaacaagatgtccaacgcaaggagagccttacctcaaagaggaacaagatcaacagtacatttgccggagagacatggtagatagagggtggggcaacggctgtggcttgtttgggaagggaggagttgtgacatgtgcgaagttttcatgcttggggaagataacgggcaacttagtccaaattgagaaccttgaatacacagtggttgtaacagtccacaatggagacactcacgctgtaggaaatgacacatctaaccatggagtgacagccacgataacccccaggtcaccatcggttgaagttaaattaccggagtacggagaattgacacttgactgtgaacctaggtccggaattgactttaatgagatgattctgatgaaaatgaaaacgaaaacgtggctcgtgcacaagcaatggtttttggatctacctctaccatggacaacaggagcagacacgctagaagttcactggaatcacaaagagagaatggtgacatttaaggttcctcatgccaagagacaggatgtgacagtgctaggatctcaggaaggagccatgcattcagccctcgccggagccacagaagtggattccggtgatggaaaccatatgtttgcaggacacttaaagtgtaaagttcgtatggaaaagttgaggatcaagggaatgtcatacacgatgtgctcaggaaagttctcaattgataaagagatggcagaaacacagcatggaacaacagtggtaaaggtcaagtatgagggtactggagctccatgtaaagttcccatagagataagagatgtgaacaaggaaaaagtggttgggcgcattatctcatccaccccttttgctgagaatactaacagtgtgaccaacatagaattggaacctccttttggggatagctacatagtgataggtgtgggagacggtgcattaacactccattggttcaggaaagggagctccattggcaagatgtttgagtccacatacagaggtgcaaagcgcatggccattctaggtgaaacagcttgggattttggttccgttggtggactgctcacgtcattaggaaaggctgtacaccaggtttttggcagtgtgtacacaactatgtttggaggagtctcatggatggtcagaatcctaatcgggctcttagtgttgtggattggtacgaattcaagaaacacttcaatggctatgtcgtgcatagctgttggaggaatcaccctgtttctgggcttcacagtccatgcagacatgggttgtgtggtgtcatggagtgggaaagagttgaaatgtggaagcggaatttttgtaattgacaacgtgcacacttggacagaacagtacaaatttcaaccagagtctccagcgcgactggcgtcggcaatactgaatgcccacaaagaaggggtctgtggaattagatcaaccacgaggctggaaaatgtcatgtggaaacaaataactaatgagttaaactatgttctctgggaaggaggacatgacctcactgtagtggccggggatgtgaaaggggtgttgtccaaaggcaagagagcactcgcacctccagtgaatgacctgaaatattcatggaagacatgggggaaagcaaagatctttactccagaaacaagaaacagtacatttttggtggacggaccagacacctccgaatgccccaatgaacgaagagcatggaactttcttgaggtggaagactatggatttggcatgttcacgaccaacatatggatgaaattccgagaaggaagttcagaagtgtgtgaccataggctgatgtcagcagcaatcaaagaccagaaagctgtgcatgctgatatgggctattggatagagagctcaaaaaaccagacctggcagatagagaaggcatccctcatagaagtgaaaacatgtctgtggcccaagacccacacattgtggagcaatggagtgctggaaagccagatgctcatcccaaaagcatatgcaggccctatctcacagcacaactatcgccagggctatgccacgcagaccgcgggcccatggcacttgggcaaattggaaatagactttggagaatgccccggaacaacagtcactgtacaagaggattgtgaccatagaggcccatctttgaggaccaccactgcatctggaaaattggtcacgcagtggtgctgtcgctcctgcacgatgcctcccttaagatttttaggagaggatggatgctggtatgggatggaaatcaggcccttgaatgaaaaagaagagaacatggtcaaatcacaggtttcagccggacagggtacatcagagactttttctatggggctgttgtgcctgactttgtttgtggaagaatgcttgaggagaagagtcaccaggaaacacatgatgttggttgtggtgaccaccctttgtgccatcattttaggaggtcttacatggatggacttactgcgtgccctcatcatgctaggggacaccatgtctggtagaatggggggacaaattcatctagccatcatggcagtgttcaagatgtcaccaggatacgtgttgggtatatttctgaggaaactcacctcaagagagacagcactgatggtaataggaatggccatgacaacggtgcttgcaattccacatgaccttatggaatttattgatggaatatcattagggttaattttattaaaaatggtaacacattttgacaacactcaagtgggaaccttagcccttgccttaaccttcataaaatcaacaatgccattggtcatggcttggaggaccataatggctgtgttgtttgtggtcacactcattcctctatgtaggacaagctgtcttcaaaagcagtcccattgggtggaaataacagcactcatcctgggagcccaggctctgccagtatacctaatgactctcatgaaaggagcctcaaaaagatcttggccccttaacgagggtataatggctgtgggcttggtcagtctcttaggaagcgccctcctaaagaatgatgtccctttagctggcccaatggtggcaggaggtttacttctggcagcctacgtgatgagcggcagctcagcagacctgtcactagagaaggctgccaatgtgcggtgggatgagatggcagacataacaggctcaagcccaatcatagaagtgaagcaggatgaagatggctctttttccatacgggacgtcgaggaaaccaacatgattaccctcctggtgaaactggcactgataacagtgtcaggtctctaccccttggcaattccagtcacaatgaccttatggtacatgtggcaagtgaaaacacaaagatcaggagccctgtgggacgtcccctcacctgctgccgctcagaaagctacactgactgagggagtatacaggatcatgcaaagagggttgtttgggaaaacccaggttggagtagggatacacacggaaggtgtgtttcatacaatgtggcatgtaacaagaggatcagtaatttgccatgagagtgggagactggagccatcttgggctgacgtcaggaacgacatgatatcatatggtgggggatggaggctcggagacaaatgggataaagaagaagatgttcaagttctagctatagaaccaggaaaaaatccgaaacatgtccaaacgaaacccggcctcttcaaaacccttactggagaaattggagcagtaacattggacttcaaacccggaacatccggttcccccatcattaacaggaaaggaaaagtcatcggactctacggaaatggggtagttaccaaatcaggtgattacgttagtgccataacacaagctgaaagaattggtgagccagactatgaagtggatgaggacattttccgaaagaaaagattaaccataatggatttacatcccggagccggaaagacaaaaagaatcctcccatcaatagttagagaagccttaaaaaggaggctgcgaaccttgattctggctcccacgagagtggtggcggccgaaatggaagaagcgctacgtggactgccaatccgttatcagaccccagctgtgaaatcagaacacacaggaagagagatcgtagacctcatgtgtcatgcaacctttacaacaagacttttatcatcgaccagggttccaaattacaacctcatagtgatggatgaagcgcatttcacagacccttctagtgttgcagctagaggatatatctcaaccagggtggaaatgggagaggctgcagctatctttatgactgcaacccctcctggaacgacagatcccttcccccagagcaacagcccaatagaagacatcgagagagaaatcccagaaaggtcatggaacacagggtttgactggataacggactaccaagggaaaactgtgtggtttgttcccagcataaaagctggaaatgacattgcaaattgcttgagaaaatcgggaaagaaggtcatccaattgagcaggaaaaccttcgatacagagtatccaaaaacgaaactcacggactgggattttgtggttaccacagacatatctgaaatgggggccaattttagagctgggagagtgatagaccccaggagatgcctcaagccagttatcttaactgatgggccagagagagttattttagctggtcccattccagtgactccagcaagcgctgctcagagaagagggcgaataggtaggaacccagcacaagaagatgaccagtatgtcttctccggagacccactaaggaatgatgaagatcatgcccactggactgaagcaaagatgcttcttgataatatctacaccccagaagggatcattccaacactgtttggtccagaaagggaaaaaacccaagccattgatggagagttccgcctcagaggggagcaaaggaagacctttgtagaattaatgaggagaggagaccttccggtgtggctgagctacaaggtagcttctgctggtatctcttacaaagaccgggaatggtgctttacgggggaaaggaataaccaaattctggaagaaaacatggaggttgaaatttggactagagagggagagaagaaaaaactcaggccaaaatggttagatgcacgtgtttacgctgatcccatggctttgaaggatttcaaggagtttgccagtggaagaaagagtataaccctcgacatcttgacagaaattgccagtttgccaacgtacctttcctccagggctaagctcgcccttgacaacatagtcatgctccatacaacagaaagaggagggaaggcctaccaacacgctctgaacgaactcccagagtcactagaaacactcatgcttgtagctttattaggagccatgacagcaggcatcttcctattcttcatgcaaggaaaaggaataggaaaattgtcaatgggtttgatagccattgcggtagctagtggcttactctgggtggcagaaatccagccccaatggatagcggcctcaatcatattggagttttttctcatggtgttgttggtaccagaaccagaaaaacaaaggaccccacaagacaatcaattgatctacgtcatattgaccattcttactattattgctctcgtggcagccaatgagatggggctaattgaaaaaacaaaaacggattttgggttttaccaggtgaaagcagaaaccaccatccttgatgtggacttgagaccagcttcagcatggacgctctatgcagtagctaccactatcttgactcccatgctgaggcacaccatagaaaacacgtctgcaaacttatccttggctgccattgccaaccaagcagccgtcctgatggggcttggaaaaggatggccgctccacagaatggacctcggtgtgccgctattggcaatgggatgctattcccaagtgaacccaacaactttaacagcatccttagtcatgcttctggtccattatgcaataataggtccaggattgcaggccaaagccacaagagaggctcaaaaaaggacagctgctgggatcatgaagaaccccacggtggacgggataacagttatagatctagaaccaatatcctatgacccaaaatttgagaagcagctggggcaagtcatgctactagttctgtgcgctggacagctactcttgatgagaacaacatgggccttttgtgaagtcttgactttggccacaggaccaatcttgaccttgtgggaaggcaacccgggaaggttttggaacacgacaatagccgtgtccactgccaacattttcaggggaagctacttggcgggagctggattggccttttcgctcataaagaatgcacaaacccccaggaggggaactgggaccacaggagagacactgggagaaaaatggaagagacagctaaactcgctagataggaaggagtttgaagagtacaaaagaagtggaatactagaagtggacaggactgaagccaagtctgccctaaaagatgggtccaaaatcaagtacgcagtgtccagaggtaccagcaagatcagatggattgttgaaagagggatggtaaagccaaaagggaaagttgtggatcttggttgcggaaggggaggatggtcgtactatatggcgacactcaagaacgtgaccgaggtgaaagggtatacgaaaggaggtccaggacatgaggaaccaattcccatggctacctatggctggaacttggtcaaactccattcaggggttgacgtgttctacaaacccactgagcaagtggacactttgctctgtgatattggggagtcatcctctaatccgacgatagaggaaggaagaacattacgagttttaaagatggtggagccatggctctcttcaaaacctgaattctgcatcaaagtcctcaatccctacatgccaacagtcatagaggagctggagaaactgcagagacgatatggtggaagtcttgtcagatgcccgctatccaggaattccactcatgagatgtattgggtgtcgggtgtgtcaggaaacatcgtgagttctgtgaacacaacatcaaagatgttgttgaacagatttaccacaaggcacaggaaacccacttatgagagggacgcagaccttggagcaggaacgagaagtgtctccaccgaaacagaaaaaccagacatgacaatcatcgggagaagactccagcgattgcaagaagagcacaaagaaacttggcactatgatcatgaaaatccatacagaacctgggcgtatcatggaagctatgaagctccctcgacaggctcagcatcttccatggtgaacggggtagttaaactgctgacaaaaccctgggacgtggttccaatggtgactcagttggctatgacagatacgaccccctttgggcaacagagagtgttcaaggagaaggttgacaccagaacaccacagccaaaacccggtacacgagtagtcatgaccacgacagccaactggctgtggactctcctcgggaggaagaaaaatcccagactgtgcacaagggaagaattcatctcaaaagttaggttaaacgcagccataggcgcagtctttcaggaagaacagggatggacatcagccagtgaggcagtgaatgacagccggttttgggaactggttgacaaagaaagggctctacaccaggaagggaaatgtgaatcatgtgtctataacatgatgggaaaacgtgaaaaaaaattaggagaatttggcagagccaagggaagccgagcaatctggtacatgtggctgggagcgcggtttctggaatttgaagccctgggctttttgaatgaagatcactggtttggcagggaaaactcatggagtggagtggaaggggaaggtctgcataggttgggatacatcttggaggacatagacaagaaggatggagatttgatatatgctgatgacacagcaggctgggacacaagaatcactgaagatgaccttctgaatgaagagctgatcacggaacagatggcccctcatcataaaatcctagctaaagccattttcaagctaacttatcaaaacaaagtggtaaaagtcctcagacccacaccgaaaggagcagtgatggacattatatccaggaaagatcaaagaggtagtggacaggttggaacatatggtttgaacacattcaccaacatggaagtgcaactcatccgccaaatggaagctgaaggagtcattacacgagatgacatgcataacccaaaagggttgaaagaaagagttgagaaatggctgaaagagtgtggtgtcgacaggttaaagaggatggcaattagtggagacgattgtgtggtgaaacctctagatgagaggttcagcacttccctcctctttttgaacgacatgggaaaggtgaggaaagacattccgcaatgggaaccatctaagggatggaaaaactggcaagaggttcctttttgctcccaccattttcacaagatctttatgaaggatggccgttcactggtcgttccatgtagaaaccaggatgaactaatagggagagccagaatctcgcaaggggctggatggagtttaagagaaacggcctgtctgggcaaagcttacgcccagatgtggtcgctcatgtactttcatagaagggacctacgtttagcctccatggctatatgctcagcagtcccaacggaatggtttccaacaagcagaacaacatggtcaatccacgctcatcatcagtggatgactactgaagatatgctaaaagtgtggaacagagtgtggatagaagacaaccctaacatgattgataaaactccagttcactcgtgggaagatataccttacctagggaaaagagaggatttgtggtgtggatccttgattggactctcttctagggccacctgggccaagaacattcacacagccataacccaggtcaggaacctgatcgggaaagaagaatatgtggattacatgccagccatgagaagatacagcgctcatttcgagagtgaaggagttctgtaa

SEQ ID NO: 7847 - RNA, 9867 nt, synthetic construct
  misc_feature 1..9867: note = derived and/or modified CDS sequence (wt) from DENV-4__JN638572__SS-prME
  source 1..9867: mol_type = other RNA
tcaacaataacactgctgtgcttgattcccactgtaatggcgtttcacttgtcaacgagagatggtgaacccctcatgatagtggcgaaacacgaaagggggagacctctcttgtttaagacaacagaaggaatcaataagtgcactcttattgccatggacctgggtgagatgtgcgaggacaccgtcacgtataaatgccccttactggtcaataccgaacccgaagacattgattgctggtgcaatctcacgtctgcctgggttatgtatgggacatgcacccaaagtggagaacgaaggcgagagaagcgctcagtagctctaacaccacattcaggaatgggattggaaacaagggctgaaacatggatgtcatcggaaggagcctggaaacacgcccagagggtagagagttggatactcagaaacccaggattcgcgctcttggcagggtttatggcatacatgatcgggcaaacaggaatccagcgaacagtcttcttcattctaatgatgttggtcgccccatcttacggaatgcgatgcgtaggagtagggaacagagactttgtagaaggagtctcaggtggagcatgggtcgatctggtgctagaacatggaggatgtgtcactaccatggcccagggaaagccaactttggattttgaactgatcaagacaacagccaaggaagtggccctgttaagaacctattgcattgaagcttccatatcaaacataaccacagcaacaagatgtccaacgcaaggagagccttacctcaaagaggaacaagatcaacagtacatttgccggagagacatggtagatagagggtggggcaacggctgtggcttgtttgggaagggaggagttgtgacatgtgcgaagttttcatgcttggggaagataacgggcaacttagtccaaattgagaaccttgaatacacagtggttgtaacagtccacaatggagacactcacgctgtaggaaatgacacatctaaccatggagtgacagccacgataacccccaggtcaccatcggttgaagttaaattaccggagtacggagaattgacacttgactgtgaacctaggtccggaattgactttaatgagatgattctgatgaaaatgaaaacgaaaacgtggctcgtgcacaagcaatggtttttggatctacctctaccatggacaacaggagcagacacgctagaagttcactggaatcacaaagagagaatggtgacatttaaggttcctcatgccaagagacaggatgtgacagtgctaggatctcaggaaggagccatgcattcagccctcgccggagccacagaagtggattccggtgatggaaaccatatgtttgcaggacacttaaagtgtaaagttcgcatggaaaagttgaggatcaagggaatgtcatacacgatgtgctcaggaaagttctcaattgataaagagatggcagaaacacagcatggaacaacagtggtaaaggtcaagtatgagggtactggagctccatgtaaagttcccatagagataagagatgtgaacaaggaaaaagtggttgggcgcattatctcatccaccccttttgctgagaataccaacagtgtgaccaacatagaattggaacctccttttggggatagctacatagtgataggtgtgggagacggtgcattaacactccattggttcaggaaagggagctccattggcaagatgtttgagtccacatacagaggtgcaaagcgcatggccattctaggtgaaacagcttgggattttggttccgttggtggactgctcacgtcattaggaaaggctgtacaccaggtttttggcagtgtgtacacaactatgtttggaggagtttcatggatggtcagaatcctaatcgggctcttagtgttgtggattggtacgaattcaagaaacacttcaatggctatgtcgtgcatagctgttggaggaatcaccctgtttctgggcttcacagtccatgcagacatgggttgtgtggtgtcatggagtgggaaagagttgaaatgtggaagcggagtttttgtaattgacaacgtacacacttggacagaacagtacaaatttcaaccagagtctccagcgcgactggcgtcggcaatactgaatgcccacaaagaaggggtctgtggaattagatcaaccacgaggctggaaaatgtcatgtggaaacaaataactaatgagttaaactatgttctctgggaaggaggacatgacctcactgtagtggccggggatgtgaaaggggtgttgtccaaaggcaagagagcactcgcacctccagtgaatgacctgaaatattcatggaagacatgggggaaagcaaagatctttactccagaaacaagaaacagcacatttttggtggacggaccagacacctccgaatgccccaatgaacgaagagcatggaactttcttgaggtggaagactatggatttggcatgttcacgaccaacatatggatgaaatttcgagaaggaagttcagaagtgtgtgaccataggctgatgtcagcagcaatcaaagaccagaaagctgtgcatgctgatatgggctattggatagagagctcaaaaaaccagacctggcagatagagaaggcatccctcatagaagtgaaaacatgtctgtggcccaagacccacacattgtggagcaatggagtgctggaaagccagatgctcatcccaaaagcatatgcaggccctatctcacagcacaactatcgccagggctatgccacgcagaccgcgggcccatggcacttgggcaaattggaaatagactttggagaatgccccggaacaacagtcactgtacaagaggattgtgaccatagaggcccatctttgaggaccaccactgcatctggaaaattggtcacgcagtggtgctgtcgctcctgcacgatgcctcccttaagatttttaggagaggatggatgctggtatgggatggaaatcaggcccttgaatgaaaaagaagaaaacatggtcaaatcacaggtttcagccggacagggtacatcagagactttttctatggggctgttgtgcctgactttgtttgtggaagaatgcttgaggagaagagtcaccaggaaacacatgatattggttgtggtgaccaccctttgtgccatcattttaggaggtcttacatggatggacttactgcgtgccctcatcatgctaggggacaccatgtctggtagaatggggggacaaattcatctagccatcatggcagtgttcaagatgtcaccaggatacgtgttgggtatatttctgaggaaactcacctcaagagagacagcactgatggtaataggaatggccatgacaacggtgcttgcaattccacatgaccttatggaatttattgatggaatatcattagggttaattttattaaaaatggtaacacattttgacaacactcaagtgggaaccttagcccttgccttaaccttcataaaatcaacaatgccattggtcatggcttggaggaccataatggctgtgttgttcgtggtcacactcattcctctatgtaggacaagctgtcttcaaaagcagtcccattgggtggaaataacagcactcatcctgggagcccaggctctgccagtatacctaatgactctcatgaaaggagcctcaaaaagatcttggccccttaacgagggtataatggctgtgggcttggtcagtctcttaggaagcgcccttctaaagaatgatgtccctttagctggcccaatggtggcaggaggtttacttctggcagcctacgtgatgagcggcagctcagcagacctgtcactagagaaggctgccaatgtgcggtgggatgagatggcagacataacaggctcaagcccaatcatagaagtgaagcaggatgaagatggctctttctccatacgggacgtcgaggaaaccaacatgattaccctcctggtgaaactggcactgataacagtgtcaggtctctaccccttggcaattccagtcacaatgaccttatggtacatgtggcaagtgaaaacacaaagatcaggagccctgtgggacgtcccctcacctgctgccgctcagaaagctacactgactgagggagtatacaggatcatgcaaagagggttgtttgggaaaacccaggttggagtagggatacacacggaaggtgtgtttcatacaatgtggcatgtaacaagaggatcagtaatttgccatgagagtgggagactggagccatcttgggctgacgtcaggaacgacatgatatcatatggtgggggatggaggctcggagacaaatgggataaagaagaagatgttcaagttctagctatagaaccaggaaaaaatccgaaacatgtccaaacgaaacccggcctcttcaaaacccttactggagaaattggagcagtaacattggacttcaaacccggaacatccggttcccccatcattaacaggaaaggaaaagtcatcggactctacggaaatggggtagttaccaagtcaggtgattacgttagtgccataacacaagctgaaagaattggtgagccagactatgaagtggatgaggacattttccgaaagaaaagattaaccataatggatttacatcccggagccggaaagacaaaaagaatcctcccatcaatagttagagaagccttaaaaaggaggctgcgaaccttgattctggctcccacgagagtggtggcggccgaaatggaagaagcgctacgtggactgccaatccgttatcagaccccagctgtgaaatcagaacacacaggaagagagatcgtagacctcatgtgtcatgcaacctttacaacaagacttttatcatcgaccagggttccaaattacaaccttatagtgatggatgaagcgcatttcacagacccttctagtgttgcagctagaggatatatctcaaccagggtggaaatgggagaggctgcagctatctttatgactgcaacccctcctggtacgacagatcccttcccccagagcaacagcccaatagaagacatcgagagagaaatcccagaaaggtcatggaacacagggtttgactggataacggactaccaagggaaaactgtgtggtttgttcccagcataaaagctggaaatgacattgcaaattgcttgagaaaatcgggaaagaaggtcatccaattgagcaggaaaaccttcgatacagagtatccaaaaacgaaactcacggactgggattttgtggttaccacagacatatctgaaatgggggccaattttagagctgggagagtgatagaccccaggagatgcctcaagccagttatcttaactgatgggccagagagagttattttagctggtcccattccagtgactccagcaagcgctgctcagagaagagggcgaataggtaggaacccagcacaagaagatgaccagtatgtcttctccggagacccactaaggaatgatgaagatcatgcccactggactgaagcaaagatgcttcttgataatatctacaccccagaagggatcattccaacactgtttggtccagaaagggaaaaaacccaagccattgatggagagttccgcctcagaggggagcaaaggaagacttttgtggaattaatgaggagaggagaccttccggtgtggctgagctacaaggtagcttctgctggtatctcttacaaagaccgggaatggtgctttacgggggaaaggaataaccaaattctggaagaaaacatggaggttgaaatttggactagagagggagagaagaaaaaactcaggccaaaatggttagatgcacgtgtttacgctgatcccatggctttgaaggatttcaaggagtttgccagtggaagaaagagtataaccctcgacatcttgacagaaattgccagtttgccaacgtacctttcctccagggctaagctcgcccttgacaacatagtcatgctccatacaacagaaagaggagggaaggcctaccaacacgctctgaacgaactcccagagtcactagaaacactcatgcttgtagctttattaggagccatgacagcaggcatcttcctattcttcatgcaaggaaaaggaataggaaaattgtcaatgggtttgatagccattgcggtagctagtggcttactctgggtggcagaaatccagccccaatggatagcggcctcaatcatattggagttctttctcatggtgttgttggtaccagaaccagaaaaacaaaggaccccacaagacaatcaattgatctacgtcatattgaccattcttactattattgctctcgtggcagccaatgagatggggctaattgaaaaaacaaaaacggattttgggttttaccaggtgaaagcagaaaccaccatccttgatgtggacttgagaccagcttcagcatggacgctctatgcagtagctaccactatcttgactcccatgctgaggcacaccatagaaaacacgtctgcaaacttatccttggctgccattgccaaccaagcagccgtcctgatggggcttggaaaaggatggccgctccacagaatggacctcggtgtgccgctattggcaatgggatgctattcccaagtgaacccaacaactttaacagcatccttagtcatgcttctggtccattatgcaataataggtccaggattacaggcaaaagccacaagagaggcccagaaaaggacagctgctgggatcatgaagaaccccacggtggacgggataacagtaatagatctagaaccaatatcctatgacccaaaatttgaaaagcaattagggcaagtcatgctactagtactgtgtgttggacaattacttttgatgagaacaacatgggctctctgcgaagtattgactttggccacaggaccaatcatgaccttgtgggagggcaacccgggaaggttttggaacacgaccatagctgtatccacagccaacatttttagaggaagctacttggcgggagctggactagctttttcgctcataaagaatgcacaaacccctaggaggggaactgggaccacaggagagacactgggagagaagtggaagagacagctaaactcattagacagaaaagagtttgaagagtacaagagaagtggaatactagaagtggataggactgaagccaagtctgccctaagagatggatctaaaaccaagcatgcggtgtccagagggtctagtaagatcagatggattgttgaaagagggatgataaagccaaaaggaaaggtcgtggatcttggttgcgggaggggaggatggtcctattacatggcgacactacagaacgtgaccgaggtgaaagggtatacgaaaggaggtccaggacatgaggaaccgattcccatggctacctatggctggaacttggtcaaactccattcaggggttgacgtgttctacaaacccactgagcaagtggacactttgctctgtgatattggggagtcatcctctaatccgacgatagaggaaggaagaacattacgagttttaaagatggtggagccatggctctcttcaaaacctgaattctgcatcaaagtcctcaatccctacatgccaacagtcatagaggagctggagaaactgcagagacgatatggtggaagtcttgtcagatgcccgctatccaggaattccactcatgagatgtattgggtgtcgggtgtgtcaggaaacatcgtgagttctgtgaacacaacatcaaagatgttgttgaacagatttaccacaaggcacaggaaacccacttatgagagggacgcagaccttggagcaggaacgagaagtgtctccaccgaaacagaaaaaccagacatgacaatcatcgggagaagactccagcgattgcaagaagagcacaaagaaacttggcactatgatcatgaaaatccatacagaacctgggcgtatcatggaagctatgaagctccctcgacaggctcagcatcttccatggtgaacggggtagttaaactgctgacaaaaccctgggacgtggttccaatggtgactcagttggctatgacagatacgaccccctttgggcaacagagagtgttcaaggagaaggttgacaccagaacaccacagccaaaacccggtacacgagtagtcatgaccacgacagccaactggctgtggactctcctcgggaggaagaaaaatcccagactgtgcacaagggaagaattcatctcaaaagttaggtcaaacgcagccataggcgcagtctttcaggaagaacagggatggacatcagccagtgaagctgtgaatgacagccggttttgggaactggttgacaaagaaagggctctacaccaggaagggaaatgtgaatcatgtgtctataacatgatgggaaaacgtgaaaaaaaattaggagaatttggcagagccaagggaagccgagcaatctggtacatgtggctgggagcgcggtttctggaatttgaagccctgggctttttgaatgaagatcactggtttggcagagaaaactcatggagtggagtggaaggggaaggtctgcataggttgggatacatcttggaggacatagacaagaaggatggagatttgatatatgctgatgacacagcaggctgggacacaagaatcactgaagatgaccttctgaatgaagagctgatcacggaacagatggcccctcatcataaagtcctagctaaagccattttcaaactaacttatcaaaacaaagtggtaaaagtcctcagacccacaccgaaaggagcagtgatggacattatatccaggaaagatcaaagaggtagtggacaggttggaacatatggtttgaacacattcaccaacatggaagtgcaactcatccgccaaatggaagctgaaggagtcattacacgagatgacatgcataacccaaaagggttgaaagaaagagttgagaaatggctgaaagagtgtggtgtcgacaggttaaagaggatggcaattagtggagacgattgtgtggtgaaacctctagatgagaggttcagcacttccctcctctttttgaacgacatgggaaaggtgaggaaagacattccgcaatgggaaccatccaagggatggaaaaactggcaagaggttcctttttgctcccaccattttcacaagatctttatgaaggatggccgttcactggtcgttccatgtagaaaccaggatgaactaatagggagagccagaatctcgcaaggggctggatggagtttaagagaaacggcctgtctgggcaaagcttacgcccagatgtggtcgctcatgtactttcatagaagggacctacgtttagcctccatggctatatgctcagcagtcccaacagaatggtttccaacaagcagaacaacatggtcaatccacgctcatcaccagtggatgaccactgaagatatgcttaaagtgtggaacagagtgtggatagaagacaaccccaacatgactgacaagactccagtccattcgtgggaagacataccttacctagggaaaagagaggatctgtggtgtggatccctgattggactttcctccagagccacctgggcgaagaacattcacacggccataacccaggtcaggaatctgatcggaaaagaggaatacatggattacatgccagtcatgaaaagatacagcgctccttccgagagtgaaggagttctgtaa

SEQ ID NO: 7848 - RNA, 9867 nt, synthetic construct
  misc_feature 1..9867: note = derived and/or modified CDS sequence (wt) from DENV-4__JX024757__SS-prME
  source 1..9867: mol_type = other RNA
tcaacaatgacattgctgtgtttgattcccaccgtaatggcgttccacttgtcaacaagagacggcgaacccctcatgatagtggcaaaacacgaaagggggagacctctcttgtttaagacaacagaaggaatcaacaaatgcaccctcattgccatggacctaggtgaaatgtgtgaagacactgtcacgtataaatgtcctctactggttaacaccgaacctgaagacattgattgctggtgcaatctcacgtccacttgggtcatgtacgggacatgcacccagagcggagaacggaggcgagagaagcgctcagtagccctaacaccacattcaggaatgggattggaaacaagagctgagacatggatgtcatcggaaggggcttggaaacatgctcagagagtggaaagctggatactcagaaacccaggattcgcgctcctggcaggatttatggcttacatgattgggcaaacaggaatccagcgaactgttttctttgtcctaatgatgctagtcgccccatcttacggaatgcgatgcgtgggggtagggaacagagactttgtggaaggagtttcgggtggggcatgggtcgacctggtgctagaacatggaggatgcgttacaaccatggcccagggaaaaccaaccttggattttgaactgaccaagacaacagctaaggaagtggctctgctaagaacctattgcattgaagcttcaatatcaaacataaccacggcaacaagatgtccaacgcaaggagagccttatctcaaagaggaacaagaccaacagtacatttgccggagagatgtggtagatagagggtggggcaatggctgtggcttgtttggaaaaggaggagttgtgacatgtgcgaagtttttatgctcggggaagataacaggcaatctggtccaaattgaaaaccttgaatatacggtagttgtgacagtccacaatggagacacccatgcagtaggaaatgacacatccaatcatggagtgacagccacgataactcctaggtcaccatcggtagaagtcaaattgccggactatggagaactaacactcgattgtgaacccaggtctggaattgatttcaatgagatgatcctgatgaaaatgaaaaagaaaacgtggcttgtgcacaagcaatggtttttggacctacctctaccatggtcagcaggagcagacacatcagaagttcattggaattacaaagagagaatggtgacattcaaagttcctcatgccaagagacaggatgtgacagtactaggatctcaggagggagctatgcattctgccctcgccggagccacagaagtggattctggtgatggaaaccacatgtttgcaggacatcttaagtgcaaggttcgtatggagaaattgagaattaagggaatgtcatacacgatgtgttcaggaaagttctcaattgacaaagagatggcagaaacacagcatgggacaacagtggtgaaagtcaagtacgaaggcgctggagctccgtgtaaagtccccatagagataagagatgtgaacaaggaaaaagtagttgggcgcatcatctcatccaccccttttgctgagaataccaacagcgtaaccaacatagaattagaacccccttttggggacagctacatagtgataggtgttggagacagtgcattaacactccattggttcaggaaagggagctccattggcaagatgtttgagtccacatacagaggtgcaaaacgaatggccattctaggtgaaacagcttgggattttggttctgttggtggactgttcacatcactgggaaaggctgtacaccaagtttttgggagtgtgtatacaaccatgtttggaggggtctcatggatgattagaatcctaattgggttcttagtattgtggattggcacgaattcaagaaatacttcaatggcaatgacgtgcatagctgttggaggaatcactctgtttctaggtttcacagttcaagcagacatgggttgtgtggtgtcatggaatgggaaggaactaaaatgtggaagcggaatctttgtggttgacaacgtgcacacttggacagaacagtacaaattccaaccagagtccccagcgaggctagcgtctgcaatattgaatgcccacaaagatggggtctgtggaatcagatcaaccacgaggctggaaaatgttatgtggaagcaaataaccaacgagctaaactatgttctctgggaaggaggacatgacctcactgtagtggctggggacgtgaaaggggtgttgaccaaaggcaagagagcactcacacctccagtgaatgatttgaaatattcatggaagacatggggaaaagcaaaaatctttaccccagaagcaagaaatagcacatttttaatagacggaccagacacctccgaatgccccaatggacgaagagcatggaactttttggaggtagaagactatggatttggcatgtttacgaccaacatatggatgaaattccgagaaggaagctcagaagtgtgtgaccatagattaatgtcggcggcaatcaaagatcagaaagctgtgcatgctgacatgggttattggatagagagctcaaaaaaccagacctggcaaatagagaaagcatctcttattgaagtgaaaacatgcctgtggcccaaaacccacacgctgtggagcaatggagtgctggaaagtcagatgctcattccaagatcatatgcaggccctttttcacagcacaattaccgccagggctatgccacgcaaaccgcgggcccatggcacttaggcaaattggagatagactttggagaatgtcccggaacaacagtcacaattcaggaggattgtgaccatagaggcccatctttgaggaccaccactgcatctggaaaactggtcacgcagtggtgttgccgctcctgcacgatgcctcccttaaggttcttgggagaagatggatgttggtacgggatggagattaggcccttgagtgaaaaagaagagaacatggtcaaatcacaggtaacagccggacagggcacatcagaaactttttctatggggctgctatgcctgaccttgttcgtggaagaatgcttaaggagaagagtcactaggaaatacatgatgttggttgtggtaatcaccttctgtgctatcatcctaggaggtctcacatggatggacttactacgagcccttatcatgttaggggacactatgtctggcagaataggaggacagattcacctagccatcatggcagtgttcaagatgtcaccaggatatgtgttgggtgtgtttttaaggaaacttacttcaagagagacagcgctaatggtaataggaatggccatgacaactgtgttttcaattccacatgacctcatggaactcattgatggaatatcattggggttgatattactaagaatagtaacacactttgataacacccaagtgggaaccttagccctttccctgactttcataagatcaacaacaccattggtcatggcttggaggaccatcatggctgtgttctttgtggttacactcattcctttgtgcagaacaagctgtcttcaaaaacagtcccattgggtagaaataacagcacttatcttaggggcccaggctttgccagtgtacctaatgaccctcatgaaaggagcctcaagaagatcttggcctcttaatgagggcataatggctgtgggtttggtgagcctcttgggaagcgccctcctaaagaatgatgttcctttagccggcccaatggtggcaggaggcttgcttctagcggcttacgtaatgagtggcagctcagcagacctgtcactagagaaggctgctaatgtgcaatgggatgaaatggcggacataactggctcaagcccaatcatagaagtgaaacaggatgaagatggctctttctccatacgggacgtcgaggaaaccaacatgataaccctcttggtgaaactggcgctgataacagtatcaggtctttaccccttggcaattccagtcacaatggcactatggtatatttggcaagtgaaaacacaaagatcaggagctctgtgggacgtcccctcacccgctgccactcagaaagccacactgtctgaaggggtgtataggatcatgcaaagagggttgttcgggaaaactcaggttggagtagggatacacatggaaggtgtatttcacacaatgtggcatgtaacaagaggatcagtgatctgccatgagacagggagattagagccatcttgggccgacgtcaggaatgacatgatatcatacggtgggggatggaggctcggagacaaatgggacaaagaagaagatgttcaggtcctagccatagaaccaggaaaaaatcccaaacatgtccaaacgaaaccaggccttttcaagaccctaactggagaaatcggagcagtaactctggatttcaaacccggaacgtctggctctcccatcataaacaagaaagggaaagttatcggactctatggaaatggagtagttaccaaatcaggtgattacgttagtgccataacgcaagccgaaagaattggtgagccagattatgaagtggatgaggacatttttcgaaagaaaagattaactataatggacttacaccccggagccggaaagacaaaaagaattctcccatcaatagtcagagaagctttgaaaaggaggctgcgcaccttgattttggcccccacgagagtggtggcggccgagatggaagaggccttacgcggactgccaatccgttatcagaccccggctgtgaaatcagagcacacaggaagagagattgtagacctcatgtgtcatgcaaccttcacaacgagacttttgtcatcaaccagggttccaaattataacctcatagtgatggatgaagcacattttactgacccttgtagtgtcgcagctagaggatacatttcaaccagggtggaaatgggagaggcagcagctatcttcatgactgcaacccctcctggatcaatagatcccttcccccagagcaacagcccaatagaagacatcgagagggaaatcccagaaaggtcatggaacacagggttcgactggataacagactaccaaggaaaaactgtgtggtttgttcccagcataaaagctggaaatgacattgcaaattgtttgagaaagtcgggaaagagagtgatccagttgagcagaaaaacctttgacacagagtatccaaagacgaaactcacggattgggattttgtggttaccacagacatatctgaaatgggagctaatttcagagccgggagagtgatagaccccaggagatgcctcaagccagttatcctaacagatgggccagagagagttattctagcaggtccaattccagtaactccagcaagtgccgctcagagaagagggcgaataggtaggaatccagcacaagaagatgaccaatatgttttctccggagacccactaaagaatgatgaagatcatgcccactggacagaagcaaagatgttgcttgacaatatctacactcctgaagggataattccaacattgtttggtccggaaagggaaaaaacccaagccattgatggagagtttcgcctcagaggggaacaaaggaagacatttgtggaactgatgaggagaggggaccttccggtgtggctgagctacaaggtagcttctgccggtatctcttataaagaccgagaatggtgctttacaggggaaaggaataaccaaattttagaagaaaacatggaggttgaaatctggactagagagggagaaaagaaaaagctaaggccaaaatggttagatgcacgtgtgtacgctgaccccatggctttgaaggatttcaaggagtttgccagtggaagaaagagcataactcttgacatcctaacagagattgctactttgccaacttacctttcctctaaggccaagctagcccttgacaacatagtcatgctccacacaacagaaaaaggagggagggcctaccaacacgccctgaatgaactcccggagtcactggaaacactcatgcttgtagccctactaggtgctttgacagccggtatcttcctgtttttcatgcaggggaaaggaatagggaaattgtcaatgggtctgatagccatagctgtggccagtggcttgctctgggtagcagaaattcagccccagtggatagcagcttcaatcatactggagttttttcttatggtgctgttgataccagaaccagaaaaacaaaggaccccacaagacaatcaactgatctacgttatattgaccattctcaccattattggtctcatagcagccaatgagatggggctgattgaaaaaacaaaaacggactttgggttctaccaggtaaaaacagaaaccaccattctcgatgtggatttgagaccagcctcagcatggacactctacgcagtggctaccactattctgactcccatgctgagacacaccatagagaacacgtctgccaacctatctttggcagccattgccaaccaagcagctgtcctaatgggacttgggaaaggatggccgctccacagaatggacctcggcgtgccgctgctagcaatgggatgttattctcaagtgaacccaacaaccctgacagcatccctagtcatgcttttagtccattatgccataataggtccaggattacaggcaaaagccactagagaggcccagaaaaggacagctgctgggatcatgaaaaaccccacggtggacgggataacagtaatagatctagaaccaatatcctatgacccaaaatttgaaaagcaattagggcaagtcatgctactagtcctgtgtgttggacaattacttttaatgagaacaacatgggctctctgtgaagtattgactctggccacaggaccaatcatgaccttgtgggagggcaacccgggaagattttggaacacaaccatagcagtatccacagccaatatttttagaggaagctacttggcgggagctggactagctttttcgctcataaaaaatgcacaaacccctaggaggggaactgggaccacaggagagacactgggagagaagtggaagagacagctgaactcattagacagaaaagagtttgaagagtacaaaagaagtggaatactagaagtggacaggactgaagccaagtctgccctaagagatggatctaaaatcaagcacgcggtgtccagagggtctagtaagatcagatggattgttgaaagaggaatgataaaaccaaaaggaaaggtcgtagatcttggttgcgggaggggaggatggtcctattacatggcgacactcaagaacgtgactgaagtgaaaggatatactaaaggaggtccaggacatgaagaaccaatccccatggctacttatggctggaatttggtcaaactccattcaggggttgatgtgttctacaaacccactgagcaggtggacaccctgctatgtgacattggagagtcatcctctaatccgacaatagaggaaggaagaacattgagagtcttaaagatggtggagccatggctctcttcaaaacctgagttctgcatcaaagtcctcaacccctacatgccgacagttatagaagagctggagaaactgcagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacaatcattgggagaaggcttcagagattgcgagaagagcacaaagaaacctggcactatgaccaggaaaacccatacagaacctgggcgtatcatgggagctatgaagctccttcgacaggctcagcatcctccatggtgaacggggtagtaaaactgctgacaaaaccctgggatgtgattccaatggtgactcagttggccatgacagacacaaccccttttgggcaacaaagagtgttcaaggagaaggtggataccagaacaccacaaccaaaacccggcacacgaatgattatgaccatgacagccaattggttatgggccctcctcgggaagaagaaaagtcccagactgtgcacaagggaagagttcatctcaaaagttaggtcaaatgcagccataggcgcagtctttcaggaagaacagggatggacatcagccagtgaagctgtgaatgacagccggttctgggaactggttgacaaagaaagggctctgcaccaggaaggaaaatgtgaatcgtgtgtctataacatgatgggaaaacgtgagaaaaaattaggagagtttggtagggccaagggaagccgagcaatctggtacatgtggctgggggcgcggttcctggaatttgaagccctgggttttttgaacgaagatcactggtttagcagagaaaactcatggagtggagtggaaggggaaggtctgcatagattgggatacatcttggaggacatagacaagaaggatggagacctgatatatgctgacgacacagcaggctgggacacgagaatcactgaagatgaccttttaaatgaagaactgatcacagaacagatggcccctcaccacaagaccctagccaaagccattttcaaactaacctatcaaaacaaagtggtgaaagtcctcagacccacaccgaaaggagcggtaatggacattatatccaggaaagaccaaagaggtagtggacaggttggaacatatggtttaaatacattcactaacatggaagtccaactcatccgccaaatggaagctgaaggagtcatcacacaagacgacatgcagaacccaagagggttgaaagaaagagttgagaaatggctgaaagagtgtggcgtcgacaggttgaagaggatggcaatcagtggagatgattgcgtggtgaagcccatagatgagaggtttagcacctccctcctcttcttgaatgacatgggaaaggtgaggaaagacatcccgcaatgggaaccatccaagggatggaaaaattggcaagaggttcctttctgctcccaccatttccacaagatcttcatgaaagatggccgctcactggttgttccatgcagaaaccaggatgaactgataggaagagccagaatctcgcagggggctggatggagcttgagagaaacagcctgtctgggcaaagcttatgcccagatgtggtcgcttatgtatttccatagaagggacctgcgcctagcctccatggccatatgctcagcggttccaacagaatggtttccaacaagcagaacaacatggtcaatccatgctcatcaccagtggatgaccactgaagatatgcttaaagtgtggaacagagtgtggatagaagataaccccaatatgactgacaagactccagtccattcgtgggaagacataccttacctagggaaaagagaggatctgtggtgtggatccctgattggactttcctctagagcaacctgggcgaagaacattcacacggccataacccaggtcaggaatctgatcggaaaagaggaatacgtggattacatgccagccatgaaaagatacagcgctcctttcgagagtgaaggagttctgtaa

SEQ ID NO: 7849 - RNA, 9867 nt, synthetic construct
  misc_feature 1..9867: note = derived and/or modified CDS sequence (wt) from DENV-4__JF741967__SS-prME
  source 1..9867: mol_type = other RNA
tcaacaatgacattgctgtgtttgattcccaccgtaatggcgtttcacctgtcaacaagagatggcgaacccctcatgatagtggcaaaacacgaaagggggagacctctcttgttcaagacaacagaaggaatcaacaaatgcaccctcattgccatggacctgggtgaaatgtgtgaagacactgtcacgtataaatgtcctctactggtcaacaccgaacctgaagacattgattgctggtgcaatctcacgtccacctgggtcatgtacgggacatgtacccagagcggagaacggaggcgagaaaagcgctcagtagctttaacaccacattcaggaatgggattggaaacaagagctgagacatggatgtcatcggaaggggcctggaaacatgctcagagagtggaaagctggatactcagaaacccaggatttgcgctcctggcaggatttatggcttatatgattgggcaaacaggaatccagcgaactgtcttctttgtcctaatgatgctagtcgccccatcctacggaatgcgatgcgtaggggtagggaacagagactttgtggaaggagtctcgggtggagcatgggtcgacttggtgctagaacatggaggatgcgtcacaaccatggcccagggaaaaccaaccttggattttgaactgaccaagacaacagctaaagaagtggctctgttaagaacctattgcattgaagcttcgatatcgaacataaccacggcaacaagatgtccaacgcaaggagagccttatctcaaagaggaacaagaccagcagtacatttgccggagagatgtagtagatagagggtggggcaatggttgtggcttgtttggaaaaggaggagttgtgacatgtgcgaagtttttatgctcggggaagataacaggcaatctggtccaaattgaaaaccttgaatatacggtagttgtgacagtccacaatggaaacacccatgcagtaggaaatgacacatctaatcatggagtgacagccacgataactcccaggtcaccatcggtagaagtcaaattgccggactatggagaactaacacttgattgtgaacccaggtccggaattgacttcaatgagatgatcctgatgaaaatgaaaaagaaaacgtggcttgtgcacaagcaatggtttttggacctacctctaccatggacagcaggagcagacacatcagaagttcattggaattataaagagagaatggtgacattcaaagttcctcatgccaagagacaggatgtgacagtgctaggatctcaggagggagccatgcattctgccctcgccggagccacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtacgaaggcgctggagctccgtgtaaagttcccatagagataagagatgtgaacaaggaaaaagtagttgggcgcatcatctcatctaccccttttgctgagaataccaacagcgtaaccaacatagaattagaacccccttttggggacagctacatagtgataggtgttggagatagtgcattaacactccattggttcaggaaagggagctccattggcaagatgtttgagtccacatacagaggtgcaaaacgaatggccattctaggtgaaacagcttgggattttggttctgttggtggactgttcacatcactgggaaaggctgtacaccaagtttttggaagtgtgtatacaaccatgtttggaggggtctcatggatgattagaattctaattgggttcttagtattgtggattggcacgaattcaagaaatacttcaatggcaatgacgtgcatagctgttgggggaatcactctgtttctaggtttcacagttcaagcagacatgggttgtgtggtgtcatggaatgggaaggaactaaaatgtggaagcggaatctttgtggttgacaacgtgcacacttggacagaacagtacaaattccaaccagagtccccagcgaggctagcgtctgcaatattgaatgcccacaaagatggggtctgtggaatcagatcaaccacgaggctggaaaatgtcatgtggaagcaaataaccaacgagctaaactatgttctctgggaaggaggacatgacctcacagtagtggctggggacgtgaaaggggtgttgaccaaaggcaagagagcactcacacctccagtgaatgatctgaaatattcatggaagacatggggaaaagcaaaaatctttaccccagaagcaagaaatagcacatttttaatagacggaccagacacctccgaatgccccaatgaacgaagagcatggaacttttttgaggtagaagactatggatttggcatgtttacgaccaacatatggatgaaattccgagaaggaagttcagaagtgtgtgaccatagattaatgtcggcggcaattaaagatcagaaagctgtgcatgctgacatgggttattggatagagagctcaaaaaaccagacctggcaaatagagaaagcatcccttattgaagtgaaaacatgcctgtggcccaaaacccacacgttgtggagcaatggagtgctggaaagtcagatgctcattccaagatcatatgcaggccctttttcacagcacaattaccgccagggctatgccacgcaaaccgcgggcccatggcacttgggcaaattggagatagactttggagaatgtcccggaacaacagtcacaattcaggaggattgtgaccatagaggcccatctttgaggaccaccactgcatctggaaaactagtcacgcagtggtgctgccgctcctgcacgatgccccccttaaggttcttgggagaagatggatgctggtacgggatggagattaggcccttgagtgaaaaagaagagaacatggtcaaatcacaggtaacagccggacagggtacatcagaaactttttctatggggctgctatgcctgaccttgttcgtggaagaatgcttaaggagaagagtcactaggaaacacatgatattggctgtggtaatcaccttctgtgctatcatcctaggaggtctcacatggatggacttactacgagtccttatcatgttaggggacactatgtctggtagaataggaggacagattcacctagccatcatggcagtgttcaagatgtcaccaggatatgtgctgggtgtgtttttaaggaaacttacttcaagagagacagcgttaatggtaataggaatggccatgacaacggtgttttcaattccacatgatctcatggaactcattgatggaatatcattggggttgatattactaaaaatagtaacacactttgataacacccaagtgggaactttagccctttccctgactttcataagatcaacaacaccattagtcatggcttggaggaccatcatggctgtgttctttgtggtcacactcattcctttgtgcaggacaagctgtcttcaaaaacagtcccattgggtagaaataacagcacttatcttaggagcccaggctttgccagtgtacctaatgactctcatgaaaggagcctcaagaagatcttggcctctcaatgagggcataatggctgtgggtctggtgagcctcttaggaagcgccctcttaaagaatgatgttcctttagctggcccaatggtggcaggaggcttacttctagcggcttacgtaatgagtggtagctcagcagacctgtcactagagaaggctgccaatgtgcaatgggatgaaatggcggacataactggctcaagcccgatcatagaagtgaagcaggatgaagatggctctttctccatacgggaagtcgaggaaaccaacatgataaccctcttggtgaaactagcgctgataacagtatcaggtctttaccccttggcaattccagttacaatggcactatggtatgtttggcaagtgaaaacacaaagatcaggagctctgtgggacgtcccctcacccgctgccactcataaagccacactgtctgaaggggtgtataggattatgcaaagagggttgttcgggaaaactcaggttggagtggggatacacatggaaggtgtattccacacagtggggcacgtaacaagaggatcagtgatctgccatgaaacagggagattagagccatcttggggtgacgtcaggaatgacatgatatcatacggtgggggatggaggctcggagacaagtgggacaaagaagaagatgttcaggtcctagccatagaaccaggaaaaaatcctaaacatgtccaaacgaaaccaggccttttcaagaccttaactggagaaattggagcagtaactctggatttcaaacccggaacgtctggctctcctatcataaacaagaaagggaaagttattggactctatggaaatggagtagttaccaaatcaggtgattacgtcagtgccataacgcaagccgaaagaattggtgagccagattatgaagtggatgaggacatcttccgaaagaaaagattaaccataatggacttacaccccggagccgggaaaacaaaaagaattctcccatcaatagtcagagaagctttgaaaaggaggctgcgaaccttgattctggcccccacgagagtggtggcggccgagatggaagaggccttacgcggactgccaatccgttatcagaccccagctgtgaaatcagagcacacaggaagagagattgtagacctcatgtgtcatgcaaccttcacaacgagacttttgtcatcaaccagggttccaaattataacctcatagtgatggatgaagcacattttactgacccttgtagtgtcgcagctagaggatacatctcaaccagggtggaaatgggagaggcagcagctatcttcatgactgcaacccctcctggatcgatagatcccttcccccagagcaacagcccaatagaagacatcgagagggaaatcccagaaaggtcatggaacacagggttcgactggataacagactaccaagggaaaacggtgtggtttgttcccagcataaaagctggaaatgacattgcaaattgtttgagaaagtcgggaaagagagtgatccagttgagcagaaaaacctttgacacagagtatccaaagacgaaactcacggactgggattttgtggtcaccacagacatatctgaaatgggagccaatttcagagctgggagagtgatagaccccaggagatgcctcaagccagttatcctgacagatgggccagagagagttattctagcaggtccaattccagtaactccagcaagtgccgctcagaggagagggcgaataggtaggaatccagcacaagaagatgaccaatatgttttctccggagacccactaaagaatgatgaagatcatgctcactggacagaagcaaagatgttgcttgacaatatctacactcctgaagggataattccaacattgtttggtccggaaagggaaaaaacccaagctattgatggagagtttcgcctcagaggggaacaaaggaagacttttgtggaattgatgaggagaggagaccttccggtgtggctgagctacaaggtagcttctgccggtatatcttacaaagaccgagaatggtgcttcacaggggaaaggaataaccaaattttagaagaaaacatggaggttgaaatatggactagagagggagaaaagaaaaagctaaggccaaaatggttagatgcacgtgtgtacgctgaccccatggctttgaaggatttcaaggagtttgccagtggaagaaagagcataactcttgacatcctaacagagattgccactttgccaacttacctttcctctaaggccaagctagcccttgacaacatagtcatgctccacacaacagaaaaaggagggagggcctaccaacatgccctgaacgaactcccggagtcactggaaacactcatgcttgtagccctactaggtgctatgacagccggtatcttcctgtttttcatgcaggggaaaggaatagggaaattgtcaatgggtctgatagccatagctgtggctagtggcttgctctgggtagcagaaattcagccccagtggatagcagcttcaatcatactggagttttttcttatggtgctgttgataccagaaccagaaaaacaaaggaccccacaagacaatcaattgatctacgttatattgaccattctcaccattattggtcttatagcagccaatgagatggggctgattgaaaaaacaaaaacggactttgggttctaccaggtaaaaccagaaaccaccattcttgatgtggatttgagaccagcctcagcgtggacactctatgcagtggccaccactattctgactcccatgctgagacacaccatagagaacacgtctgccaacctatctctagcagccattgccaaccaagcagctgtcctaatgggacttggaaaaggatggccgctccacaggatggatctcggtgtgccgctgctagcaatgggatgctattctcaagtgaacccaacaaccttgacagcatccctagttatgctcttagttcattatgccataataggtccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaagtcatgctactagtcctgtgtgttggacaattacttttgatgagaacaacatgggctctctgcgaagtactgactctggccacaggaccagtcatgaccttgtgggagggcaacccgggaaggttttggaacacaaccatagctgtatccacagctaacatttttagaggaagctacttggcgggagctggactagctttctcgctcataaagaatgcacaaacccctaggaggggaactgggaccacaggagagacactgggagagaagtggaagagacagctaaactcattagacagaaaagagtttgaagagtacaaaagaagtggaatactagaagtggataggactgaagccaagtctgccctaagagatggaaccaaaatcaagtatgcggtgtccagagggtctagtaagatcagatggattgttgaaagaggaatgataaaaccaaaaggaaaggtcgtagatcttggttgcgggaggggaggatggtcctattacatggcgacgctcaagaacgtgactgaagtgaaaggatatactaaaggaggtccaggacacgaagaaccaatccccatggctacctatggctggaatttggtcaaactccattcaggagttgatgtgttctacaaacccacagagcaggtggacaccctgctttgtgacattggggagtcatcctctaatccgacaatagaagaaggaagaacattgagagtcttgaagatggtggagccatggctctcttcaaaacctgagttctgcataaaagtcctcaacccctacatgccgacagttatagaagagctggagaaactgcagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacagtcattgggagaaggcttcagagattgcgagaagagcacaaagaaacctggcactatgaccaggaaaacccatacagaacctgggcgtatcatggaagctatgaagctccttcgacaggctcagcatcctccatggtgaacggggtagtaaaactgctgacaaaaccttgggatgtgattccaatggtgactcagttggccatgacagacacaaccccttttgggcaacaaagagtgttcaaggagaaggtggataccagaacaccacaaccaaaacccggcacacggatgattatgaccacgacagccaattggttgtgggccctcctcgggaagaagaaaagtcctagactgtgcacaagggaagagttcatctcaaaagttaggtcaaatgcagccataggcgcagtcttccaggaagaacagggatggacatcagccagtgaagctgtgaatgacagccggttctgggaactggttgacaaagaaagggctctgcaccaggaaggaaaatgtgaatcgtgcgtctacaacatgatgggaaagcgtgagaaaaaattaggagagtttggtagggccaagggaagccgagcaatctggtacatgtggctgggggcgcggttcctggaatttgaagccctgggttttttgaatgaagatcactggtttagcagagaaaactcatggagtggagtggaaggggaaggtctgcacagattgggatacatcttggaggacatagacaagaaggatggagacctgatatatgctgacgacacagcaggctgggacacgaggatcactgaagatgaccttttaaatgaagaactgatcacagaacagatggcccctcaccacaagaccctagccaaagccattttcaaactaacctatcaaaacaaagtggtgaaagttctcagacccacaccgaaaggagcggtaatggacattatatccaggaaagaccaaagaggtagtggacaggttggaacatatggtttaaacacattcactaacatggaagtccaactcatccgccaaatggaagctgaaggagtcatcacacaagacgacatgcagaacccaaaagggttgaaagaaagagtcgagaaatggctgaaagagtgtggcgtcgacaggttgaagaggatggcaatcagtggagatgattgcgtggtgaagcccttagatgagaggtttagcacctccctcctcttcttgaatgacatgggaaaggtgaggaaagatatcccgcagtgggaaccatccaagggatggaaaaactggcaagaggttcctttttgctcccaccatttccacaagatcttcatgaaagatggccgctcactagttgttccatgcagaaaccaggatgaactgataggaagagccagaatctcgcagggggctggatggagcttgagagagacagcctgtctgggcaaagcttacgcccaaatgtggtcgcttatgtatttccatagaagggacctgcgcctagcctccatggccatatgctcagcagttccaacagaatggtttccaacaagcagaacaacatggtcaatccacgctcatcaccagtggatgaccactgaagatatgcttaaagtgtggaacagagtgtggatagaagataaccccaatatgactgacaagactccagtccattcgtgggaagacataccttacctagggaaaagagaggatctgtggtgcggatccctgattggactttcttccagagccacctgggcgaagaatattcacacggctataacccaggtcaggaatctgatcggaaaagaggaatatgtggattacatgccagccatgaaaagatacagcgctcctttcgagagtgaaggagttctgtaa

SEQ ID NO: 7850 - RNA, 9867 nt, synthetic construct
  misc_feature 1..9867: note = derived and/or modified CDS sequence (wt) from DENV-4__JQ822247__SS-prME
  source 1..9867: mol_type = other RNA
tcaacaatgacattgctgtgtttgattcccaccgtaatggcgtttcacctgtcaacaagagatggcgaacccctcatgatagtggcaaaacacgaaagggggagacctctcttgttcaagacaacagaaggaatcaacaaatgcaccctcattgccatggacctgggtgaaatgtgtgaagacactgtcacgtataaatgtcctctactggtcaacaccgaacctgaagacattgattgctggtgcaatctcacgtccacctgggtcatgtacgggacatgtacccagagcggagaacggaggcgagaaaagcgctcagtagctttaacaccacattcaggaatgggattggaaacaagagctgagacatggatgtcatcggaaggggcctggaaacatgctcagagagtggaaagctggatactcagaaacccaggatttgcgctcctggcaggatttatggcttatatgattgggcaaacaggaatccagcgaactgtcttctttgtcctaatgatgctagtcgccccatcctacggaatgcgatgcgtaggggtagggaacagagactttgtggaaggagtctcgggtggagcatgggtcgacttggtgctagaacatggaggatgcgtcacaaccatggcccagggaaaaccaaccttggattttgaactgaccaagacaacagctaaagaagtggctctgttaagaacctattgcattgaagcttcgatatcgaacataaccacggcaacaagatgtccaacgcaaggagagccttatctcaaagaggaacaagaccagcagtacatttgccggagagatgtagtagatagagggtggggcaatggttgtggcttgtttggaaaaggaggagttgtgacatgtgcgaagtttttatgctcggggaagataacaggcaatctggtccaaattgaaaaccttgaatatacggtagttgtgacagtccacaatggaaacacccatgcagtaggaaatgacacatctaatcatggagtgacagccacgataactcccaggtcaccatcggtagaagtcaaattgccggactatggagaactaacacttgattgtgaacccaggtccggaattgacttcaatgagatgatcctgatgaaaatgaaaaagaaaacgtggcttgtgcacaagcaatggtttttggacctacctctaccatggacagcaggagcagacacatcagaagttcattggaattataaagagagaatggtgacattcaaagttcctcatgccaagagacaggatgtgacagtgctaggatctcaggagggagccatgcattctgccctcgccggagccacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtacgaaggcgctggagctccgtgtaaagttcccatagagataagagatgtgaacaaggaaaaagtagttgggcgcatcatctcatctaccccttttgctgagaataccaacagcgtaaccaacatagaattagaacccccttttggggacagctacatagtgataggtgttggagatagtgcattaacactccattggttcaggaaagggagctccattggcaagatgtttgagtccacatacagaggtgcaaaacgaatggccattctaggtgaaacagcttgggattttggttctgttggtggactgttcacatcactgggaaaggctgtacaccaagtttttggaagtgtgtatacaaccatgtttggaggggtctcatggatgattagaattctaattgggttcttagtattgtggattggcacgaattcaagaaatacttcaatggcaatgacgtgcatagctgttgggggaatcactctgtttctaggtttcacagttcaagcagacatgggttgtgtggtgtcatggaatgggaaggaactaaaatgtggaagcggaatctttgtggttgacaacgtgcacacttggacagaacagtacaaattccaaccagagtccccagcgaggctagcgtctgcaatattgaatgcccacaaagatggggtctgtggaatcagatcaaccacgaggctggaaaatgtcatgtggaagcaaataaccaacgagctaaactatgttctctgggaaggaggacatgacctcacagtagtggctggggacgtgaaaggggtgttgaccaaaggcaagagagcactcacacctccagtgaatgatctgaaatattcatggaagacatggggaaaagcaaaaatctttaccccagaagcaagaaatagcacatttttaatagacggaccagacacctccgaatgccccaatgaacgaagagcatggaacttttttgaggtagaagactatggatttggcatgtttacgaccaacatatggatgaaattccgagaaggaagttcagaagtgtgtgaccatagattaatgtcggcggcaattaaagatcagaaagctgtgcatgctgacatgggttattggatagagagctcaaaaaaccagacctggcaaatagagaaagcatcccttattgaagtgaaaacatgcctgtggcccaaaacccacacgttgtggagcaatggagtgctggaaagtcagatgctcattccaagatcatatgcaggccctttttcacagcacaattaccgccagggctatgccacgcaaaccgcgggcccatggcacttgggcaaattggagatagactttggagaatgtcccggaacaacagtcacaattcaggaggattgtgaccatagaggcccatctttgaggaccaccactgcatctggaaaactagtcacgcagtggtgctgccgctcctgcacgatgccccccttaaggttcttgggagaagatggatgctggtacgggatggagattaggcccttgagtgaaaaagaagagaacatggtcaaatcacaggtaacagccggacagggtacatcagaaactttttctatggggctgctatgcctgaccttgttcgtggaagaatgcttaaggagaagagtcactaggaaacacatgatattggctgtggtaatcaccttctgtgctatcatcctaggaggtctcacatggatggacttactacgagtccttatcatgttaggggacactatgtctggtagaataggaggacagattcacctagccatcatggcagtgttcaagatgtcaccaggatatgtgctgggtgtgtttttaaggaaacttacttcaagagagacagcgttaatggtaataggaatggccatgacaacggtgttttcaattccacatgatctcatggaactcattgatggaatatcattggggttgatattactaaaaatagtaacacactttgataacacccaagtgggaactttagccctttccctgactttcataagatcaacaacaccattagtcatggcttggaggaccatcatggctgtgttctttgtggtcacactcattcctttgtgcaggacaagctgtcttcaaaaacagtcccattgggtagaaataacagcacttatcttaggagcccaggctttgccagtgtacctaatgactctcatgaaaggagcctcaagaagatcttggcctctcaatgagggcataatggctgtgggtctggtgagcctcttaggaagcgccctcttaaagaatgatgttcctttagctggcccaatggtggcaggaggcttacttctagcggcttacgtaatgagtggtagctcagcagacctgtcactagagaaggctgccaatgtgcaatgggatgaaatggcggacataactggctcaagcccgatcatagaagtgaagcaggatgaagatggctctttctccatacgggacgtcgaggaaaccaacatgataaccctcttggtgaaactagcgctgataacagtatcaggtctttaccccttggcaattccagttacaatggcactatggtatgtttggcaagtgaaaacacaaagatcaggagctctgtgggacgtcccctcacccgctgccactcagaaagccacactgtctgaaggggtgtataggattatgcaaagagggttgttcgggaaaactcaggttggagtggggatacacatggaaggtgtattccacacaatgtggcacgtaacaagaggatcagtgatctgccatgagacagggagattagagccatcttgggctgacgtcaggaatgacatgatatcatacggtgggggatggaggctcggagacaagtgggacaaagaagaagatgttcaggtcctagccatagaaccaggaaaaaatcctaaacatgtccaaacgaaaccaggccttttcaagaccttaactggagaaattggagcagtaactctggatttcaaacccggaacgtctggctctcctatcataaacaagaaagggaaagttattggactctatggaaatggagtagttaccaaatcaggtgattacgtcagtgccataacgcaagccgaaagaattggtgagccagattatgaagtggatgaggacatcttccgaaagaaaagattaaccataatggacttacaccccggagccgggaaaacaaaaagaattctcccatcaatagtcagagaagctttgaaaaggaggctgcgaaccttgattctggcccccacgagagtggtggcggccgagatggaagaggccttacgcggactgccaatccgttatcagaccccagctgtgaaatcagagcacacaggaagagagattgtagacctcatgtgtcatgcaaccttcacaacgagacttttgtcatcaaccagggttccaaattataacctcatagtgatggatgaagcacattttactgacccttgtagtgtcgcagctagaggatacatctcaaccagggtggaaatgggagaggcagcagctatcttcatgactgcaacccctcctggatcgatagatcccttcccccagagcaacagcccaatagaagacatcgagagggaaatcccagaaaggtcatggaacacagggttcgactggataacagactaccaagggaaaacggtgtggtttgttcccagcataaaagctggaaatgacattgcaaattgtttgagaaagtcgggaaagagagtgatccagttgagcagaaaaacctttgacacagagtatccaaagacgaaactcacggactgggattttgtggtcaccacagacatatctgaaatgggagccaatttcagagctgggagagtgatagaccccaggagatgcctcaagccagttatcctgacagatgggccagagagagttattctagcaggtccaattccagtaactccagcaagtgccgctcagaggagagggcgaataggtaggaatccagcacaagaagatgaccaatatgttttctccggagacccactaaagaatgatgaagatcatgctcactggacagaagcaaagatgttgcttgacaatatctacactcctgaagggataattccaacattgtttggtccggaaagggaaaaaacccaagctattgatggagagtttcgcctcagaggggaacaaaggaagacttttgtggaattgatgaggagaggagaccttccggtgtggctgagctacaaggtagcttctgccggtatatcttacaaagaccgagaatggtgcttcacaggggaaaggaataaccaaattttagaagaaaacatggaggttgaaatatggactagagagggagaaaagaaaaagctaaggccaaaatggttagatgcacgtgtgtacgctgaccccatggctttgaaggatttcaaggagtttgccagtggaagaaagagcataactcttgacatcctaacagagattgccactttgccaacttacctttcctctaaggccaagctagcccttgacaacatagtcatgctccacacaacagaaaaaggagggagggcctaccaacatgccctgaacgaactcccggagtcactggaaacactcatgcttgtagccctactaggtgctatgacagccggtatcttcctgtttttcatgcaggggaaaggaatagggaaattgtcaatgggtctgatagccatagctgtggctagtggcttgctctgggtagcagaaattcagccccagtggatagcagcttcaatcatactggagttttttcttatggtgctgttgataccagaaccagaaaaacaaaggaccccacaagacaatcaattgatctacgttatattgaccattctcaccattattggtcttatagcagccaatgagatggggctgattgaaaaaacaaaaacggactttgggttctaccaggtaaaaccagaaaccaccattcttgatgtggatttgagaccagcctcagcgtggacactctatgcagtggccaccactattctgactcccatgctgagacacaccatagagaacacgtctgccaacctatctctagcagccattgccaaccaagcagctgtcctaatgggacttggaaaaggatggccgctccacaggatggatctcggtgtgccgctgctagcaatgggatgctattctcaagtgaacccaacaaccttgacagcatccctagttatgctcttagttcattatgccataataggtccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaagtcatgctactagtcctgtgtgttggacaattacttttgatgagaacaacatgggctctctgcgaagtactgactctggccacaggaccagtcatgaccttgtgggagggcaacccgggaaggttttggaacacaaccatagctgtatccacagctaacatttttagaggaagctacttggcgggagctggactagctttctcgctcataaagaatgcacaaacccctaggaggggaactgggaccacaggagagacactgggagagaagtggaagagacagctaaactcattagacagaaaagagtttgaagagtacaaaagaagtggaatactagaagtggataggactgaagccaagtctgccctaagagatggaaccaaaatcaagtatgcggtgtccagagggtctagtaagatcagatggattgttgaaagaggaatgataaaaccaaaaggaaaggtcgtagatcttggttgcgggaggggaggatggtcctattacatggcgacgctcaagaacgtgactgaagtgaaaggatatactaaaggaggtccaggacacgaagaaccaatccccatggctacctatggctggaatttggtcaaactccattcaggagttgatgtgttctacaaacccacagagcaggtggacaccctgctttgtgacattggggagtcatcctctaatccgacaatagaagaaggaagaacattgagagtcttgaagatggtggagccatggctctcttcaaaacctgagttctgcataaaagtcctcaacccctacatgccgacagttatagaagagctggagaaactgcagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacagtcattgggagaaggcttcagagattgcgagaagagcacaaagaaacctggcactatgaccaggaaaacccatacagaacctgggcgtatcatggaagctatgaagctccttcgacaggctcagcatcctccatggtgaacggggtagtaaaactgctgacaaaaccttgggatgtgattccaatggtgactcagttggccatgacagacacaaccccttttgggcaacaaagagtgttcaaggagaaggtggataccagaacaccacaaccaaaacccggcacacggatgattatgaccacgacagccaattggttgtgggccctcctcgggaagaagaaaagtcctagactgtgcacaagggaagagttcatctcaaaagttaggtcaaatgcagccataggcgcagtcttccaggaagaacagggatggacatcagccagtgaagctgtgaatgacagccggttctgggaactggttgacaaagaaagggctctgcaccaggaaggaaaatgtgaatcgtgcgtctacaacatgatgggaaagcgtgagaaaaaattaggagagtttggtagggccaagggaagccgagcaatctggtacatgtggctgggggcgcggttcctggaatttgaagccctgggttttttgaatgaagatcactggtttagcagagaaaactcatggagtggagtggaaggggaaggtctgcacagattgggatacatcttggaggacatagacaagaaggatggagacctgatatatgctgacgacacagcaggctgggacacgaggatcactgaagatgaccttttaaatgaagaactgatcacagaacagatggcccctcaccacaagaccctagccaaagccattttcaaactaacctatcaaaacaaagtggtgaaagttctcagacccacaccgaaaggagcggtaatggacattatatccaggaaagaccaaagaggtagtggacaggttggaacatatggtttaaacacattcactaacatggaagtccaactcatccgccaaatggaagctgaaggagtcatcacacaagacgacatgcagaacccaaaagggttgaaagaaagagtcgagaaatggctgaaagagtgtggcgtcgacaggttgaagaggatggcaatcagtggagatgattgcgtggtgaagcccttagatgagaggtttagcacctccctcctcttcttgaatgacatgggaaaggtgaggaaagatatcccgcagtgggaaccatccaagggatggaaaaactggcaagaggttcctttttgctcccaccatttccacaagatcttcatgaaagatggccgctcactagttgttccatgcagaaaccaggatgaactgataggaagagccagaatctcgcagggggctggatggagcttgagagagacagcctgtctgggcaaagcttacgcccaaatgtggtcgcttatgtatttccatagaagggacctgcgcctagcctccatggccatatgctcagcagttccaacagaatggtttccaacaagcagaacaacatggtcaatccacgctcatcaccagtggatgaccactgaagatatgcttaaagtgtggaacagagtgtggatagaagataaccccaatatgactgacaagactccagtccattcgtgggaagacataccttacctagggaaaagagaggatctgtggtgcggatccctgattggactttcttccagagccacctgggcgaagaatattcacacggctataacccaggtcaggaatctgatcggaaaagaggaatatgtggattacatgccagccatgaaaagatacagcgctcctttcgagagtgaaggagttctgtaa

SEQ ID NO: 7851 - RNA, 9867 nt, synthetic construct
  misc_feature 1..9867: note = derived and/or modified CDS sequence (wt) from DENV-4__JF262783__SS-prME
  source 1..9867: mol_type = other RNA
tcaacagtaacattgctgtgcttgattcccaccgtaatggcgtttcacctgtcaacaagagatggcgaaccccttatgatagtggcaaaacatgaaagggggagacctctcttgtttaagacaacagaaggaatcaacaaatgcactcttattgccatggacttgggtgaaatgtgtgaggacactgtcatgtacaaatgccctctactggtcaatactgaacctgaagacattgactgctggtgcaatctcacgtctacctgggtcatgtatgggacatgtacccagagcggagaacggagacgagagaagcgctcagtagctttgacaccacattcaggaatgggattggaaacaagggctgagacatggatgtcatcggaaggagcttggaagcatgcccaaagagtagagagctggatactcagaaacccaggattcgcgctcttggcaggattcatggcttacatgattgggcaaacaggaatccagcgaactgtcttctttgttctaatgatgctggtcgctccatcctacggaatgcgatgcgtgggagtggggaacagagactttgtggaaggagtctcaggtggagcatgggtcgatctggtactagaacatggaggatgcgtcacaaccatggcccagggaaaaccaaccctggattttgaactgatcaagacaacagccaaggaagtgactctgttaagaacctattgcattgaggcttcgatatcaaacataactacggcaacaagatgtccaacgcaaggagagccctatctcaaagaggaacaagatcaacagtatatttgccggagagatgtggtagacagagggtggggcaatggctgtggcttgtttggaaaaggaggagttgtgacatgtgcgaagtttttatgctcgggaaagataacaggcaatttggttcaaattgagaaccttgaatacacagtggttgtgacagtccacaacggagacacccatgtagtaggaaaagacacatccaaccacggagtgacagctacgataactcctaggtcaccatcagtagaggtcaaattaccggactatggagaattaacacttgattgtgaacccaggtccggaattgacttcaatgagatgattctaatgaaaatgaaaaagaaaacgtggcttgtgcacaagcaatggtttttggatctacctctaccatggacagcaggggcagacacatcagaagttcagtggaattacaaagagagaatggtgacattcaaggtccctcatgccaagagacaggatgtgacagtgctagggtctcaggaaggagctatgcattctgccctcaccggagctacagaagtggattccggtgatggaaaccatatgtttgcaggacatctaaagtgtaaagttcgtatggagaaattgagaatcaaaggaatgtcatatacgatgtgctcaggaaagttctcaattgacaaagagatggcagaaacacagcatgggacgacagtagtgaaagtcaagtacgaaggtgctggagctccatgtaaagtccccatagaaataagagatgtgaacaaggaaaaagtggttgggcgcatcatctcatccaccccttttgctgagaacaccaacagtgtaaccaacatagagttagaacccccctttggggacagttacatagtaataggtgttggagacagtgcattaactcttcattggttcaggaaagggagttccattggcaagatgtttgagtctacatatagaggtgcaaagcgaatggccattctaggtgaaacagcttgggattttggttcagttggtggactattcacatcattgggaaaggctgtgcaccaggtttttggtagcgtgtacacaactatgtttggaggagtctcatggatggttagaatcctaatcgggctcctagtgttgtggattggtacgaattcaagaaacacttcaatggcaatgacgtgcatagctattggaggaatcactctgtttctgggtttcacagttcacgcagacatgggttgtgcggtgtcatggagtgggaaagaattgaaatgtggaagcggaatttttgtaattgacaacgtgcacacctggacagaacagtacaaatttcaaccagagtccccagcaagactagcgtctgcaatattgaatgctcacaaagatggggtctgtggaattagatcaaccacgaggctggaaaatgtcatgtggaagcaaataaccaacgagctaaactatgttctctgggaaggaggacatgacctcactgtagtggccggggatgtgaaaggggtgttaaccaaaggcaagagagcactcacacctccagtgaatgatttgaaatattcatggaagacatggggaaaagcaaaaatcttcactccagaagcaagaaatagcacatttttgatagacggaccagacacctccgaatgccccaatgaacgaagagcatggaactttcttgaggtagaagactatggttttggcatgtttgcgaccaacatatggatgaaatttcgagaaggaagttcagaggtgtgtgatcacaggttaatgtcggcggcaatcaaagatcagaaagctgtgcatgctgacatgggctattggatagagagctcaaaaaaccagacctggcagatagagaaagcatccctcattgaagtgaaaacatgtctgtggcccaagacccacacattgtggagcaatgaagtgttggaaagccaaatgctcattccaaaagcatatgcaggccctttttcacagcataattatcgccagggctatgccacgcagaccataggcccatggcacttgggcaaattggagatagactttggagaatgccccggaacaacagtcacaattcaggaggattgtaaccatagaggtccatctttgaggaccactactgcatctggaaaattggtcacgcagtggtgctgccgctcctgcacgatgcctcccttaaggtttttgggagaggatgggtgttggtatgggatggaaattaggcctttaagtgaaaaagaagagaacatggtcaaatcacaggtatcggccggacagggtacatcagaaactttttctatggggctgttatgcctgaccttgtttgtggaagaatgcttgaggagaagagtcactaggaaacacatgatattggttgtggtgaccaccctttgtgccatcatcctaggaggtctcacatggatggacctactacgagctcttatcatgttaggggacaccatgtctggtaggatgggaggacagattcacctaaccattatggcagtgttcaagatgtcaccaggatatgtgctgggtgtgtttttaaggaaactcacttcgagagagacagcactaatagtaataggaatggccatgacaacagtgctttcaattccacatgacctcatggaattcatcgatggaatatcactggggttaatcttgctaaaaatggtagctcattttgataacacccaagtgggaaccttagccctttccttgactttcataagatcaacaatgccattggtcatggcctggaggaccatcatggctgtgttgtttgtggtcacactcattcctctatgtaggacaagctgtcttcaaaagcagtcccattgggtagaaataacagcactcatcctaggagctcaggctctgccagtgtacctaatgaccctcatgaaaggagcctcaaaaagatcctggcctcttaacgagggcataatggctgtgggtttggttagtctcttaggaagcgcccttttaaagaatgatgtccctctggctggcccaatggtagcgggaggcttacttctggcagcctacgtgatgagtggtagctcagcagatctgtcactagaaaaggccgccaatgtgcagtgggatgagatggcagacataacaggctcaagcccaatcatagaagtgaagcaggatgaagatggctccttctccatacgggatgtcgaggaaaccaatatgataacccttttggtgaaactggcactgataacagtgtcaggtctctaccccttggcaattccagtcacaatggccttatggtacatgtggcaggtgaaaacgcaaagatcaggggccctatgggacgtcccctcacccgctgcagctcagaaagccacactgactgaaggagtgtacaggatcatgcagagagggttgtttgggaaaactcaggttggggtggggatacacatggaaggtgtatttcacacaatgtggcatgtaacaagaggatcagtgatctgccatgagactgggagattagagccgtcttgggctgacgtcaggaacgacatgatatcatacggtgggggatggagactcggagacaaatgggacaaagaagaagatgttcaggttctagccatagaaccgggaaaaaacccgaaacatgtccaaacgaaacccggccttttcaagaccctaactggagaaattggagcagtaacattggatttcaaacccggaacgtctggctctcccatcattaacaagaaaggaagagttatcggactctatggaaatggaatagttaccaaatcaggtgattatgtcagtgccataacgcaagccgaaagaattggtgagccagattatgaagtggatgaggacattttccggaagaaaagattgactgtaatggatttacaccccggagccggaaagacaaaaagaattctcccatcaatagtcagagaagccttaaaaaggaggctacgaaccttgattttggcccccacgagagtggtggcggccgagatggaagaggcccttcgtggactgccaatccgttatcagaccccagctgtgaaatcagaacacacaggaagagaaattgtagacctcatgtgccatgcaaccttcacaacaagacttttgtcatcaaccagagttccaaattacaacctcatagtgatggatgaagcacatttcacagacccttctagtgtcgcggccagaggatacatctcaaccagggtggaaatgggagaggcagcagctatctttatgactgccacccctccaggagcgacagaccccttcccccagagcaacagcccaatagaagatatcgagagggaaattcctgaaaggtcatggaatacagggttcgactggataacagactaccaagggaaaactgtgtggtttgttcccagtataaaagctggaaatgacattgcaaattgcttgagaaagtcgggaaagaaggtgatccagttaagtaggaaaacctttgacacagagtacccaaaaacgaaactcacagactgggattttgtggtcaccacagacatatctgaaatgggggccaactttagagctaggagagtgatagaccctaggagatgcctcaagccagttatcctaacagatggaccagagagagtcattttagcaggtcccattccagtgactccagcaagtgctgctcagagaagagggcgaataggtaggaacccagcacaagaagacgaccaatacgtcttctccggagacccactaaaaaatgatgaagatcatgcccactggacagaagcaaagatgctgcttgacaatatctataccccggaaggaatcattccaacattgtttggtccagaaagggaaaaaatccaagctattgatggagagttccgcctcagaggggaacagaggaaaacttttgtggaactaatgaggagaggagaccttccggtgtggctgagctataaggtggcttctgctggcatttcttacaaagaccgggaatggtgcttcacaggggaaagaaataaccaaattttagaagaaaatatggaggttgaaatttggactagagagggagaaaagaaaaaactaaggccaaaatggttagatgcacgtgtttatgctgaccccatggctttgaaggatttcaaggagtttgccagcggaagaaagagcataacccttgacatcctaacagagattgccagtttgccaacttatctttcctctagggctaagctcgctcttgacaacatagtcatgctccacacaacagagagaggagggagggcctaccaacacgccctgaacgaactcccggagtcactggaaacactcatgctagtagccttactaggtgctatgacagcaggcatcttcctgtttttcatgcaaggaaaaggaatagggaaattgtcaatgggtttgatggccattgcggtagctagtggcttgctctgggtagcagaaattcagccccagtggatagcggcctcaatcatactggagttttttcttatggcactgttgataccagaaccagaaaaacaaaggaccccacaagacaatcaattgatctatgtcatactgaccattctcaccattattggtctcatagcagccaacgagatggggctgattgaaaaaacaaaaacggattttgggttttaccaggtaaaaacagaaaccaccatcctcgatgtggacttgagaccagcttcagcatggacgctctatgcggtagccaccactattttgactcctatgctgagacacaccatagaaaacacgtctgctaacttatctctagcggccattgccaaccaagcagctgtcctaatggggcttggaaaaggatggccactccacagaatggaccttggtgtgccgctgttggcaatgggatgttactctcaagtgaacccaacaactctgacagcatccttagtcatgctttcagtccattatgcaataataggtccaggattgcaggcaaaagccacaagagaggctcagaaaaggacagctgctgggatcatgaagaaccccacggtggacgggataacagtaatagacttagaaccaatatcctatgacccaaaatttgaaaagcaattagggcaagtcatgctactagcattgtgtgctggacaactactcttgatgagaacaacatgggctttctgtgaagtcttgactttggccacaggaccaatcttgaccttgtgggagggcaacccgggaaggttttggaacacgaccatagccgtatccactgccaatattttcaggggaagctacttggcgggagctggactggctttttcgctcataaagaacgcacaaacccccaggaggggaactgggaccacaggagagacactgggagagaagtggaagagacagctaaactcattagacaggaaggagtttgaagagtacaagagaagtggaatactagaagtggacaggactgaagccaagtctgccttaaaagatgggtccaaaatcaagcatgcagtgtccagagggtccagcaagatcagatggattgttgaaagagggatggtaaaaccaaaaggaaaagttgtggaccttggctgcgggagaggaggatggtcgtattacatggcgacacttaagaacgtgactgaggtgaaagggtatacaaaaggaggtccaggacatgaagaaccgattcccatggctacctatggctggaatttggtcaaactccattcaggagttgacgtgttctataaacccactgagcaagtggacaccctgctctgtgatattggggagtcatcttccaatccgacgatagaagaaggaagaacattgagagttttgaagatggtggaaccatggctctcttcaaaacctgaattctgcatcaaagtccttaacccctacatgccaacagtcatagaagagctggagaaactacagagaaaacatggtggaagtcttgtcagatgcccgctatccaggaattctactcatgagatgtactgggtgtcaggtgcgtcgggaaacattgtgagctctgtgaacacaacatcaaagatgttgttaaacaggtttaccacaaggcacagaaaacctacttatgagaaggatgtaaaccttggagcagggacgagaagtgtctccactgaaacagaaaaaccagacatgacaatcatcgggagaaggcttcagcggttgcgagaagagcacaaagaaacttggcactacgatcaggaaaacccatacaggacctgggcgtatcacggaagctatgaagctccttcgacaggctcagcatcctccatggtgaacggggtagtaaaactgctgacaaagccttgggacgtaattccaatggtgacccagttagccatgacagacacaaccccttttgggcaacagagagtgttcaaagagaaggtagataccagaacaccacaaccaaaacccggtacacgaatggttatgaccacaacagccaattggctgtgggccctccttgggaagaagaaaagtcccagactgtgcacaagggaagagttcatctcaaaagttaggtcaaacgcagccataggcgcagtttttcaagaagaacagggatggacatcagccagtgaagctgtgaatgacagccggttttgggaactggttgacaaagaaagggctctgcaccaggaagggaaatgtgaatcgtgtgtctataacatgatgggaaaacgtgagaaaaagctaggagagtttggtagagccaagggaagccgagcaatctggtacatgtggctgggagcgcggtttctggaatttgaagccctgggttttttgaatgaagatcactggtttggcagagaaaattcatggagtggggtggaaggggaaggtttgcatagattgggatatatcctggaggacatagacaagaaggatggagacctgatatatgctgatgacacagcaggttgggacacaagaatcactgaagatgaccttctgaatgaagaactgatcacggaacagatggctcctcatcataggatcctagccaaagccattttcaaattaacttatcaaaacaaagtggtgaaagtcctcagacccacaccgaaaggagcggtgatggatatcatatccaggaaagaccaaagaggtagtggacaggttggaacatatggtttgaacacattcaccaacatggaagtacaactcatccgccaaatggaagctgaaggagtcattacacaagatgacatgcagaacccaaaagggttgaaagaaagagttgagaaatggctgaaggagtgtggtgtcgacaggttaaagaggatggcaatcagtggagacgattgtgtggtgaagcccctggacgagaggttcagcacttccctcctctttttgaacgacatgggaaaggtgaggaaagacattccgcagtgggaaccatctaagggatggaaaaactggcaagaggttcccttttgctcccaccactttcacaagattttcatgaaggatggccgctcactagttgttccatgtagaaaccaggatgagctgatagggagagccagaatctcacagggggctggatggagtctaagagaaacagcctgtctgggcaaagcttacgcccagatgtggtcgctcatgtactttcacagaagggacctgcgtttagcctccatggccatatgctcagcagttccaacggaatggttcccaacaagcagaacaacatggtcaatccacgcccatcaccagtggatgaccactgaagatatgctcaaagtgtggaacagagtgtggatagaagacaaccctaacatgactgacaagaccccagtccattcgtgggaagacataccttacctagggaaaagagaggacttgtggtgtggatccttgattggactctcttccagagccacctgggcaaagaacattcacacagccataacccaagtcaggaacctgatcgggaaagaggagtatgtagattacatgccagtcatgaaaagatacagcgctcccttcgagagtgaaggagttctgtaa

SEQ ID NO: 7852 - RNA, 9867 nt, synthetic construct
  misc_feature 1..9867: note = derived and/or modified CDS sequence (wt) from DENV-4__KU513441__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggggttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcactctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaagagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggtaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttatggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttctctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatgttgggggacactatgtctggcagaataggaggacagacccacctagccatcatagcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagctctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactaccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtagaaatgggagaggcagcagccatcttcatgaccgcaacccctcccggagcgacggatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaatccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttaaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggaccttggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacggaataacagtgatagatctagaaccaatatcctatgacccaaaatttgaaaagcaattagggcaggtcatgttactagtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggaccgaagccaagtccgccctgaaagatgggtccaaaatcaagcatgcagtatctagagggtccagtaagattagatggatcgttgagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaatagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggttcggcacctccctcctcttcttgaacgacatgggaaaggtgaggaaagacattccgcagtgggaaccatctaagggatggaaaaactggcaagaggttcctttttgctcccaccactttcacaagatctttatgaaggacggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgtcagtaatgaaaagatacagtgctccttcagagagtgaaggagttctgtaa

SEQ ID NO: 7853 - RNA, 9867 nt, synthetic construct
  misc_feature 1..9867: note = derived and/or modified CDS sequence (wt) from DENV-4__KC762694__SS-prME
  source 1..9867: mol_type = other RNA
tcaacaatgacattgctgtgtttgattcccaccgtaatggcgtttcacctgtcaacaagagatggcgaacccctcatgatagtggcaaaacacgaaagggggagacctctcttgtttaagacaacagaaggaatcaacaaatgcaccctcattgccatggacctgggtgaaatgtgtgaagacactgtcacgtataaatgtcctctactggtcaacaccgaacctgaagacattgattgctggtgcaatctcacgtccacctgggtcatgtacgggacatgtacccagagcggagaacggaggcgagaaaagcgctcagtagctttaacaccacattcaggaatgggattggaaacaagagctgagacatggatgtcatcggaaggggcttggaaacatgctcagagagtggaaagctggatactcagaaacccaggattcgcgctcctggcaggatttatggcttacatgattgggcaaacaggaatccagcgaactgttttctttgtcctaatgatgctagtcgccccatcctacggaatgcgatgcgtaggggtagggaacagagactttgtggaaggagtctcgggtggagcatgggtcgacttggtgctagaacatggaggatgcgtcacaaccatggcccagggaaaaccaaccttggattttgaactgaccaagacaacagctaaggaagtggctctgttaagaacctattgcattgaagcttcgatatcaaacataaccacggcaacaagatgtccaacgcaaggagagccttatctcaaagaggaacaagaccagcagtacatttgccggagagatgtggtagatagagggtggggcaatggctgtggcttgtttggaaaaggaggagttgtgacatgtgcgaagtttttatgctcggggaagataacaggcaatctggtccaaattgaaaaccttgaatatacggtagttgtgacagtccacaatggagacacccatgcagtaggaaatgacacatccaatcatggagtgacagccacgataactcccaggtcaccatcggtagaagtcaaattgccggactatggagaactaacactcgattgtgaacccaggtccggaattgacttcaatgagatgatcctgatgaaaatgaaaaagaaaacgtggcttgtgcacaagcaatggtttttggacctacctctaccatggacagcaggagcagacacatcagaagttcattggaattataaagagagaatggtgacattcaaagttcctcatgccaagagacaggatgtgacagtgctaggatctcaggagggagctatgcattctgccctcgccggagccacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtacgaaggcgctggagctccgtgtaaagttcccatagagataagagatgtgaacaaggaaaaagtagttgggcgcatcatctcatctaccccttttgctgagaataccaacagcgtaaccaacatagaattagaacccccttttggggacagctacatagtgataggtgttggagatagtgcattaacactccattggttcaggaaagggagctccattggcaagatgtttgagtccacatacagaggtgcaaaacgaatggccattctaggtgaaacagcttgggattttggttctgttggtggactgttcacatcactgggaaaggctgtacaccaagtttttggaagtgtgtatacaaccatgtttggaggggtctcatggatgattagaattctaattgggttcttagtattgtggattggcacgaattcaagaaatacttcaatggcaatgacgtgcatagctgttgggggaatcactctgtttctaggtttcacagttcaagcagacatgggttgtgtggtgtcatggaatgggaaggaactaaaatgtggaagcggaatctttgtggttgacaacgtgcacacttggacagaacagtacaaattccaaccagagtccccagcgaggctagcgtctgcaatattgaatgcccacaaagatggggtctgtggaatcagatcaacctcgaggctggaaaatgtcatgtggaagcaaataaccaacgagctaaactatgttctctgggaaggaggacatgacctcactgtagtggctggggacgtgaaaggggtgttgaccaaaggcaagagagcactcacacctccagtgaatgatctgaaatattcatggaagacatggggaaaagcaaaaatctttaccccagaagcaagaaatagcacatttttaatagacggaccagacacctccgaatgccccaatgaacgaagagcatggaacttttttgaggtagaagactatggatttggcatgtttacgaccaacatatggatgaaattccgagaaggaagttcggaagtgtgtgaccatagattaatgtcggcggcaattaaagatcagaaagctgtgcatgctgacatgggttattggatagagagctcaaaaaaccagacctggcaaatagagaaagcatcccttattgaagtgaaaacatgcctgtggcccaaaacccacacgttgtggagcaatggagtgctggaaagtcagatgctcattccaagatcatatgcaggccctttttcacagcataattaccgccagggctatgccacgcaaaccgcgggcccatggcacttgggcaaattggagatagactttggagaatgtcccggaacaacagtcacaattcaggaggattgtgaccatagaggcccatctttgaggaccaccacagcatctggaaaactggtcacgcagtggtgctgccgctcctgcacgatgccccccttaaggttcttgggagaagatggatgctggtacgggatggagattaggcccttgagtgaaaaagaagagaacatggtcaaatcacaggtaacagccggacagggtacatcagaaactttttctatggggctgctatgcctgaccctgttcgtggaagaatgcttaaggagaagagtcactaggaaacacatgatattggttgtggtaatcaccttctgtgctatcatcctaggaggtctcacatggatggacttactacgagcccttatcatgttaggggacaccatgtctggtagaataggaggacagattcacctagccatcatggcagtgttcaagatgtcaccaggatatgtgctgggtgtgtttttaaggaaacttacttcaagagagacagcgctaatggtaataggaatggccatgacaacggtgttttcaattccacatgatctcatggaactcattgatggaatatcattggggttgatattactaaaaatagtaacacactttgataacacccaagtgggaactttagccctttccctgactttcataagatcaacaacaccattagtcatggcttggaggaccatcatggctgtgttctttgtggtcacactcattcctttgtgcaggacaagctgtcttcaaaaacagtcccattgggtagaaataacagcacttatcttaggagcccaggctttgccagtgtacctaatgactctcatgaaaggagcctcaagaagatcttggcctcttaatgagggcataatggctgtgggtttggtgagcctcttaggaagcgccctcttaaagaatgatgttcctttagctggcccaatggtggcaggaggcttacttctagcggcttacgtaatgagtggtagctcagcagacctgtcactagagaaggctgccaatgtgcaatgggatgaaatggcggacataactggctcaagcccgatcatagaagtgaagcaggatgaagatggctctttctccatacgggacgtcgaggaaaccaacatgataaccctcttggtgaaactggcgctgataacagtatcaggtctttaccccttggcaattccagttacaatggcactatggtatgtttggcaagtgaaaacacaaagatcaggagctctgtgggacgtcccctcacccgctgccactcagaaagccacactgtctgaaggggtgtataggatcatgcaaagagggttgttcgggaaaactcaggttggagtggggatacacatggaaggtgtattccacacaatgtggcacgtaacaagaggatcagtgatctgccatgagacagggagattagagccatcttgggctgacgtcaggaatgacatgatatcatacggtgggggatggaggctcggagacaagtgggacaaagaagaagatgttcaggtcctagccatagaaccaggaaaaaatcctaaacatgtccaaacgaaaccaggccttttcaagaccctaactggagaaattggagcagtaactctggatttcaaacccggaacgtctggctctcctatcataaacaagaaagggaaagttattggactctatggaaatggagtagttaccaaatcaggtgattacgtcagtgccataacgcaagccgaaagaattggtgagccagattatgaagtggatgaggacatctttcgaaagaaaagattaaccataatggacttacaccccggagccggaaaaacaaaaagaattctcccatcaatagtcagagaagctttgaaaaggaggctgcgaaccttgattctggcccccacgagagtggtggcggccgagatggaagaggccttacgcggactgccaatccgttatcagaccccagctgtgaaatcagagcacacaggaagagagattgtagacctcatgtgtcatgcaaccttcacaacgagacttttgtcatcaaccagggttccaaattataacctcatagtgatggatgaagcacattttactgacccttgtagtgtcgcagctagaggatacatctcaaccagggtggaaatgggagaggcagcagctatcttcatgactgcaacccctcctggatcgatagatcccttcccccagagcaacagcccaatagaagacatcgagagggaaatcccagaaaggtcatggaacacagggttcgactggataacagactaccaagggaaaactgtgtggtttgttcccagcataaaagctggaaatgacattgcaaattgtttgagaaagtcgggaaagagagtgatccagttgagcagaaaaacctttgacacagagtatccaaagacgaaactcacggactgggattttgtggtcaccacagacatatctgaaatgggagccaatttcagagctgggagagtgatagaccccaggagatgcctcaagccagttatcctgacagatgggccagagagagttattctagcaggtccaattccagtaactccagcaagtgccgctcagaggagagggcgaataggtaggaatccagcacaagaagatgaccaatatgttttctccggagacccactaaagaatgatgaagatcatgctcactggacagaagcaaagatgttgcttgacaatatctacactcctgaagggataattccaacattgtttggtccggaaagggaaaaaacccaagctattgatggagagtttcgcctcagaggggaacaaaggaagacttttgtggaattgatgaggagaggagaccttccggtgtggctgagctataaggtagcttctgccggtatatcttacaaagaccgagaatggtgcttcacaggggaaaggaataaccaaattttagaagaaaacatggaggttgaaatctggactagagagggagaaaagaaaaagctaaggccaaaatggttagatgcacgtgtgtacgctgaccccatggctttgaaggatttcaaggagtttgccagtggaagaaagagcataactcttgacatcctaacagagattgccactttgccaacttacctttcctctaaggccaagctagcccttgacaacatagtcatgctccacacaacagaaaaaggagggagggcctaccaacatgccctgaacgaactcccggagtcactggaaacactcatgcttgtagccctactaggtgctatgacagccggtatcttcctgtttttcatgcaggggaaaggaatagggaaattgtcaatgggtctgatagccatagctgtggctagtggcttgctctgggtagcagaaattcagccccagtggatagcagcttcaatcatactggagttttttcttatggtgctgttgataccagaaccagaaaaacaaaggaccccacaagacaatcaattgatctacgttatattgaccattctcaccatcattggtcttatagcagccaatgagatggggctgattgaaaaaacaaaaacggactttgggttctaccaggtaaaaacagaaaccaccattcttgatgtggatttgagaccagcctcagcgtggacactctatgcagtggccaccactattctgactcccatgctgagacacaccatagagaacacgtctgccaacctatctctagcagccattgccaaccaagcagctgtcctaatgggacttggaaaaggatggccgctccacaggatggacctcggtgtgccgctgctagcaatgggatgttattctcaagtgaacccaacaaccttgacagcatccctagttatgcttttagttcattatgccataataggtccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaagtcatgctactagtcctgtgtgttggacaattacttttgatgagaacaacatgggctctctgcgaagtgctgactctggccacaggaccagtcatgaccttgtgggagggcaacccgggaaggttttggaacacaaccatagctgtatccacagctaacatttttagaggaagctacttggcgggagctggactagctttttcgctcataaagaatgcacaaacccctaggaggggaactgggaccacaggagagacactgggagagaagtggaagagacagctaaactcattagacagaaaagagtttgaagagtacaaaagaagtggaatactagaagtggataggactgaagccaagtctgccctaagagatggatccaaaatcaagtatgcggtgtccagagggtctagtaagatcagatggattgttgaaagaggaatgataaaaccaaaaggaaaggtcgtagatcttggttgcgggaggggaggatggtcctattacatggcgacactcaagaacgtgactgaagtgaaaggatatactaaaggaggtccaggacatgaagaaccaatccccatggctacttatggctggaatttggtcaaactccattcaggagttgatgtgttctacaaacccacagagcaggtggacaccctgctttgtgacattggggagtcatcctctaatccgacaatagaggaaggaagaacattgagagtcttgaagatggtggagccatggctctcttcaaaacctgagttctgcatcaaagtcctcaatccctacatgccgacagttatagaggagctggagaaactgcagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacaatcattgggagaaggcttcagagattgcgagaagagcacaaagaaacctggcactatgaccaggaaaacccatacagaacctgggcgtatcatggaagctatgaagccccttcgacaggctcagcatcctccatggtgaacggggtagtaaaactgctgacaaaaccttgggatgtgattccaatggtgactcagttggccatgacagacacaaccccttttgggcaacaaagagtattcaaggagaaggtggataccagaacaccacaaccaaaacccggcacacggatgattatgaccacgacagccaattggttgtgggccctcctcgggaagaagaaaagtcctagactgtgcacaagggaagagttcatctcaaaagttaggtcaaatgcagccataggcgcagtctttcaggaagaacagggatggacatcagccagtgaggctgtgaatgacagccggttctgggaactggttgacaaagaaagggctctgcaccaggaaggaaaatgtgaatcgtgtgtctacaacatgatgggaaagcgtgagaaaaaattaggagagtttggtagggccaagggaagccgagcaatctggtacatgtggctgggggcgcggttcctggaatttgaagccctgggttttttgaatgaagatcactggtttagcagagaaaactcatggagtggagtggaaggggaaggtctacatagattgggatacatcttggaggacatagacaagaaggatggagacctgatatatgctgacgacacagcaggctgggacacgagaatcactgaagatgaccttttaaatgaagaactgatcacagaacagatggcccctcaccacaagaccctagccaaagccattttcaaactaacctatcaaaacaaagtggtgaaagttctcagacccacaccgaaaggagcggtaatggacattatatccaggaaagatcaaagaggtagtggacaggttggaacatatggtttaaacacattcactaacatggaagtccaactcatccgccaaatggaagctgaaggagtcatcacacaagacgacatgcagaacccaaaagggttgaaagaaagagtcgagaaatggctgaaagagtgtggcgtcgacaggttgaagagaatggcaatcagtggagatgattgcgtggtgaagcccttagatgagaggtttagcacctccctcctcttcttgaatgatatgggaaaggtgaggaaagatatcccgcagtgggaaccatccaagggatggaaaaactggcaagaggttcctttttgctcccaccatttccacaagatcttcatgaaagatggccgctcactggttgttccatgcagaaaccaggatgaactgataggaagagccagaatctcgcagggggctggatggagcttgagagaaacagcctgtctgggcaaagcttacgcccagatgtggtcgcttatgtatttccatagaagggacctgcgcctagcctccatggccatatgctcagcagttccaacagaatggtttccaacaagcagaacaacatggtcaatccacgctcatcaccagtggatgaccactgaagatatgcttaaagtgtggaacagagtgtggatagaagataaccctaatatgactgacaagactccagtccattcgtgggaagacataccttacctagggaaaagagaggatctgtggtgcggatccctgattggactttcttccagagccacctgggcgaagaacattcacacggccataacccaggtcaggaatctgatcggaaaagaggaatacgtggattacatgccagccatgaaaagatacagcgctcctttcgagagtgaaggagttctgtaa

SEQ ID NO: 7854 - RNA, 9867 nt, synthetic construct
  misc_feature 1..9867: note = derived and/or modified CDS sequence (wt) from DENV-4__KC762695__SS-prME
  source 1..9867: mol_type = other RNA
tcaacaatgacattgctgtgtttgattcccactgcaatggcgtttcacctgtcaacaagagacggcgaacccctcatgatagtggcaaaacacgaaagggggagacctctcttgtttaagacaacagaaggaatcaacaaatgcaccctcatagccatggacctgggtgaaatgtgtgaagacactgtcacgtataaatgtcctctattagttaacaccgaacctgaagacattgattcctggtgcaatctcacgtccacctgggttatgtacgggacatgcacccagagcggagaacggaggcgagaaaagcgctcagtagctttaacaccacattcaggaatgggattggaaacaagagctgagacatggatgtcatcggaaggggcttggaaacatgctcagagagtggaaagctggatactcagaaacccaggattcgcgcttctggcaggattcatggcttacatgattgggcaaacaggaatccagcgaactgttttctttgtcctaatgatgctagttgccccatcctacggaatgcgatgcgtaggggtagggaacagagactttgtggaaggagtctcgggtggggcatgggtcgacttggtgctagaacatggaggatgtgtcacaaccatggcccagggaaaaccaaccttggattttgaactgaccaagacaacagctaaggaagtagctctgttaagaacctattgcattgaagcttcgatatcgaacataaccacggcaacaagatgtccaacgcaaggagagccttatctcaaagaggaacaagaccaacagtacatttgccggagagacgtggtagacagagggtggggcaatggctgtggcttgtttggaaaaggaggagttgtgacatgtgcgaagtttttatgctcggggaagataacaggcaatctggtccaaattgaaaaccttgaatatacggtagttgtgacagtccacaatggagacacccatgcagtaggaaatgacacatccaatcatggagtgacagctacgataactcccaggtcaccatcggtagaagttaaattgccggactatggagaactaacactcgattgtgaacccaggtccggaattgatttcaatgagatgatcctgatgaaaatgaaaaagaaaacgtggcttgtgcacaagcaatggttcttggacctacctctaccgtggacagcaggagcagacacatcagaagtccattggaattacaaagagagaatggtgacattcaaagttcctcatgccaagagacaggatgtgacagtgctaggatctcaggagggagctatgcattctgccctcgccggagccacagaagtggattctggtaatggaaatcacatgtttgcaggacatctcaagtgcaaagttcgtatggagaaattgagaattaagggaatgtcatacacgatgtgttcaggaaagttctcaattgacaaagagatggcagaaacacagcatgggacaacagtggtgaaagtcaagtatgaaggcgctggagctccatgtaaagttcccatagagataagagatgtgaacaaggaaaaagtagttgggcgcatcatctcatccaccccttttgccgagaacaccaacagcgtaaccaacatagaattagaacccccttttggggacagctacatagtgataggtgttggagatagtgcattaacactccattggttcaggaaagggagctccattggcaagatgtttgagtccacatacagaggtgcaaaacgaatggccattctaggtgaaacagcttgggattttggttctgttggtggactgtttacgtcactgggaaaggctatacaccaagtttttggaagtgtgtatacaaccatgtttggaggggtctcatggatgatcagaatcctaattgggctcttagtattgtggattggcacgaattcaagaaacacttcaatggcaatgacgtgcatagctgttggaggaatcactctgtttctaggtttcacagttcaagcagacatgggttgtgtggtgtcatggaatgggaaggaactaaaatgtggaagcggaatttttgtggttgacaatgtgcatacttggacagaacagtacaaattccaaccagagtccccagcgaggctagcttctgcaatattgaatgcccacaaagatggggtctgtggaatcagatcaaccacgaggctggaaaatgttatgtggaagcaaataaccaacgagctaaactatgttctctgggaaggaggacatgacctcactgtagtggccggggatgtgaagggggtgttgaccaaaggcaagagagcactcacacctccagtgaatgatctgaaatattcatggaagacatgggggaaagcaaaaatcttcaccccagaagcaagaaatagcacatttttaatagacggaccagacacctccgaatgccccaatgaacgaagagcatggaactttttggaggtagaagactatggatttggcatgttttcgaccaacatatggatgaaattccgagaaggaagttcagaagtgtgtgaccatagattaatgtcggcggcaatcaaagatcagaaagctgtgcatgctgacatgggttattggatagagagctcaaaaaaccagacctggcagatagagaaagcatcccttattgaagtgaaaacatgtctgtggcccaaaacccacacgctgtggagcaatggagtgctggaaagtcagatgctcattccaagatcatatgcaggccctttttcacagcacaattaccgccagggctatgccacgcaaatcgcgggcccatggcacttaggcaaattggagatagactttggagaatgcccaggaacaacagtcacgattcaggaggattgtgaccatagaggcccatctttgaggactaccactgcatctggaaaactggtcacgcaatggtgctgccgctcctgcacgatgcctcccttaaggttcttgggagaagatggatgttggtatgggatggagattaggcccttgagtgaaaaagaagagaacatggtcaaatcacaggtgacagccggacagggtacatcagaaactttttctatggggttgctatgcctgaccttgttcgtggaagagtgcttaaggagaagagtcactaggaaacacatgatattggttgtgacaatcaccttctgtgctatcatcttaggaggtctcacatggatggacttactacgagcccttatcatgttaggggacactatgtctggtagaatagggggacagattcacctagccattatggcagtgttcaagatgtcaccaggatatgtgctgggtgtgtttttaaggaaacttacttcaagagagacagcgctaatggtaataggaatggccatgacaacggtgttttcaattccacatgacctcatggaactcattgatggaatatcattggggttgatattactaaaaatagtaacacactttgatgacacccaagtgggaaccttagccctttccctgactttcataagatcaacaacaccattagtcatggcttggaggaccatcatggctgtgttctttgtggtcacactcattcctttgtgcaggacaagctgtcttcaaaaacagtcccattgggtggaaataacagcacttatcttaggagcccaggctttgccagtgtacctaatgactctcatgaaaggagcctcaagaagatcttggcctcttaatgagggcataatggctgtgggtttggtgagcctcttaggaagcgccctcctaaagaatgatgttcctttagctggcccaatggtggcaggaggcttacttctagcggcttacgtaatgagtggtagctcagcagacctgtcactagagaaggctgccaatgtgcagtgggatgaaatggcggacataactggctcaagcccaatcatagaagtgaagcaggatgaagatggctctttttccatacgggatgtcgaggaaaccaacatgataaccctcttggtgaaactggcgctgataacagtatcaggtctttaccccctggcaattccagtcacaatggcactatggtatatttggcaagtgaaaacacaaagatcaggagctctatgggacgtcccctcacctgttgccactcagaaagccacactgtctgaaggggtgtataggatcatgcaaagagggttgtttggaaaaactcaggttggagtagggatacacatggaaggtgtattccacacaatgtggcacgtgacaagaggatcagtgatctgccatgagacagggagattagagccatcttgggctgacgtcaggaatgacatgatatcatacggtgggggatggaggctcggagacaaatgggacaaagaagaagatgttcaggtcctagccatagaaccagggaaaaatcctaaacatgtccaaacgaaaccaggccttttcaagaccctaactggagaaattggagcagtaactctggatttcaaacccggaacgtctggctctcccatcattaacaagaaagggaaagttattggactctatggaaatggagtagttaccaaatcaggtgattacgtcagtgccataacgcaagccgaaagaattggtgagccagattatgaagtggatgaggacatttttcgaaagaaaagattaactataatggacttacaccctggagctggaaagacaaaaagaattctcccatcaatagtcagagaagctttgaaaaggaggctgcgaaccttgattttggctcccacgagagtggtggcggccgagatggaagaggctctacgcggactgccaatccgttatcagaccccagctgtgaaatcagagcacacaggaagagagatagtagacctcatgtgtcatgcaaccttcacaacgcgacttctgtcatcaaccagggttccaaattataacctcatagtgatggatgaagcacatttcactgacccttgtagtgtcgcggctagaggatacatttcaaccagagtggagatgggagaggcagcagctatctttatgactgcaacccctcctggatcgacagatccctttccccagagcaacagcccaatagaagacatcgagagggaaatcccagaaaggtcatggaacacagggttcgactggataacagactaccaagggaaaactgtgtggttcgttcctagcataaaagctggaaatgacattgcaaattgtttgagaaagtcgggaaagagagtgatccagttgagcagaaaaacctttgacacagagtatccaaagacaaaactcacggactgggattttgtggtcaccacagacatatctgaaatgggggccaatttcagagctgggagagtaatagaccccaggagatgcctcaagccagttatcctaacagatgggccagagagagttattctagcaggtccaattccagtaactccagcaagtgccgctcagagaagagggcgaataggtaggaatccagcacaagaagatgaccaatatgttttctccggagacccactaaagaatgatgaagatcatgctcactggacagaagcaaagatgttgcttgacaatatctacacccctgaagggataattccaacattgtttggtccggaaagggaaaaaacccaagccattgatggagagtttcgcctcagaggggaacaaaggaagacttttgtggaattgatgaggagaggagaccttccggtgtggctgagctacaaggtagcttcggccggtatctcttacaaagaccgagaatggtgcttcacaggggaaaggaataaccaaattttagaagaaaacatggaggttgaaatctggactagagagggagaaaagaaaaaactaaggccaaaatggttagatgcacgtgtgtacgctgaccccatggctctaaaggatttcaaggagtttgccagtggaagaaagagcataacccttgacatcctaacagagattgccactttgccaacttacctttcctctaaggccaagctagcccttgacaacatagtcatgctccacacaacagaaaaaggagggagggcctaccaacacgccctgaacgaactcccggagtcactggaaacactcatgcttgtagccctactaggtgctatgacagccggcatcttcctgtttttcatgcaggggaaaggaatagggaaattgtcaataggtctgatagccatagctgtggctagtggcttgctctgggtagcagaaattcagccccagtggatagcagcttcaattatactggagttttttcttatggtgctgttgataccagaaccagaaaaacaaaggaccccacaagacaatcaattgatctacgttatattgaccattctcaccattattggtctcatagcagccaatgagatggggctgattgaaaaaactaaaacggactttgggttctaccaggtaaaaacagaaaccaccattcttgatgtggatttgagaccagcctcagcatggacactctatgcagtggccaccactattctgactcccatgctgagacacaccatagagaacacgtctgccaacctatctctagcagccattgccaaccaagcagctgtcctaatgggacttggaaaaggatggccgctccacagaatggacctcggtgtgccgctgttagcaatgggatgttattctcaagtgaacccaacaaccctgacagcatccctagtcatgcttttagtccattatgccataataggtccaggattgcaggcaaaagccacaagagaggcccagaaaaggacagctgctgggatcatgaagaaccccacggtggacgggataacagtaatagatctagaaccaatatcctatgacccaaaatttgaaaagcaattagggcaagtcatgctactagtactgtgtgttggacaattacttttgatgagaacaacatgggctctctgcgaagtattgactttggcaacaggaccaatcatgaccttgtgggagggcaacccgggaaggttttggaacacgaccatagctgtatcaacagctaacatttttagaggaagctacttggcgggagctggactagctttttcgctcataaagaatgcacaaacccccaggaggggaactgggaccacaggagagacactgggagagaagtggaagagacagctaaactcattagacagaaaagagtttgaagaatacaaaagaagtggaatactagaagtggataggactgaagccaagtctgccctaagagatggatctaagatcaagcatgcggtgtccagagggtctagtaagatcagatggattgttgaaagagggatgataaagccaaaaggaaaggtcgtggatcttggttgcgggaggggaggttggtcctattacatggcgacactcaagaacgtgactgaagtgaaaggatacacaaaaggaggtccaggacatgaagaaccaatccccatggctacttatggctggaatttggtcaaactccattcaggggttgatgtgttctacaaacccactgagcaggtggacaccctgctctgtgacattggggagtcatcctctaatccgacaatagaggaaggaagaacactgagagtcttgaagatggtggagccatggctctcttcaaaacctgagttctgcatcaaagtcctcaacccctacatgccgacagttatagaagagctggaaaaactgcagagaagacatggtggaagcctcgtcagatgtccgctatctaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcgggtacgagaagtgtctccactgaaacagaaaaaccagacatgacaatcattgggagaaggcttcagagattgcgagaagagcacaaagaaacctggcactatgaccaggaaaacccatacagaacctgggcgtatcatggaagctatgaagctccttcgacaggctcagcatcttccatggtgaacggggtagtaaaactgctgacaaaaccttgggatgtgattccaatggtgacccagttggccatgacagacacaaccccttttgggcaacaaagagtgttcaaggagaaggtggataccagaacaccacaaccaaaacccggcacacgaatgattatgaccacgacagccaattggttgtgggccctcctcgggaagaagaaaagtcccagactgtgcacaagggaagagttcatctcaaaagttaggtcaaatgcagccataggcgcagtctttcaggaagagcagggatggacatcagccagtgaagctgtgaatgacagccggttctgggaactggttgacaaagaaagggctctgcaccaggaaggaaaatgtgaatcgtgtgtctataacatgatgggaaaacgtgagaaaaaactgggagagtttggtagggctaagggaagccgagcaatctggtacatgtggctgggggcgcggttcctggaatttgaagccctgggttttttgaatgaagatcactggtttagcagagaaaactcatggagtggagtggaaggggaaggtctgcacagattgggatacatcttggaggacatagacaagaaggatggagacctgatatatgctgacgacacagcaggctgggacacgagaatcactgaggatgaccttttaaatgaagaactgatcacagaacagatggcccctcaccacaagaccctagccaaagccattttcaaactaacctatcaaaacaaagtggtgaaagtcctcagacccacaccgaaaggagcggtaatggacatcatatccaggaaagaccaaagaggtagtggacaggttggaacatatggtttaaacacattcactaacatggaagttcaactcatccgccaaatggaagctgaaggagtcatcacacaagacgacatgcagaacccaaaagggttggaagaaagagttgagaaatggctgaaagagtgtggcgtcgacaggttaaagaggatggcaatcagtggagatgattgcgtggtgaagcccttagatgagaggtttagcacctccctcctcttcttgaatgacatgggaaaggtgaggaaagacatcccgcagtgggaaccatccaagggatggaaaaactggcaagaggttcctttttgctcccaccattttcacaagatcttcatgaaagatggccgctcactggttgttccatgcagaaaccaggatgaactgataggaagagccagaatctcgcagggggctggatggagcttgagagaaacagcctgtctgggcaaagcttacgcccagatgtggtcgctcatgtacttccatagaagggacctgcgcctagcctccatggccatatgctcagcagttccaacagaatggtttccaataagcagaacaacatggtcaatccacgctcatcaccagtggatgaccactgaagatatgcttaaagtgtggaacagagtgtggatagaagacaaccccaatatgactgacaagactccaatccattcgtgggaagacataccttacctagggaaaagagaggatctgtggtgtggatctttgattggactttcttccagagccacctgggcgaagaacattcacacggccatatctcaggtcaggaatctgatcggaaaagaggaatacgtggattacatgccagtcatgaaaagatacagcgctccctccgagagtgaaggagttctgtaa

SEQ ID NO: 7855 - RNA, 9867 nt, synthetic construct
  misc_feature 1..9867: note = derived and/or modified CDS sequence (wt) from DENV-4__KC762696__SS-prME
  source 1..9867: mol_type = other RNA
tcaacaatgacattgctgtgtttgattcccaccgtaatggcgtttcacctgtcaacaagagatggcgaacccctcatgatagtggcaaaacacgaaagggggagacctctcttgtttaagacaacagaaggaatcaacaaatgcaccctcattgccatggacctgggtgaaatgtgtgaagacactgtcacgtataaatgtcctctactggtcaacaccgaacctgaagacattgattgctggtgcaatctcacgtccacctgggtcatgtacgggacatgtacccagagcggagaacggaggcgagaaaagcgctcagtagctttaacaccacattcaggaatgggattggaaacaagagctgagacatggatgtcatcggaaggggcttggaaacatgctcagagagtggaaagctggatactcagaaacccaggattcgcgctcctggcaggatttatggcttacatgattggacaaacaggaatccagcgaactgttttctttgtcctaatgatgctagtcgccccatcctacggaatgcgatgcgtaggggtagggaacagagactttgtggaaggagtctcgggtggagcatgggtcgacttggtgctagaacatggaggatgcgtcacaaccatggcccagggaaaaccaaccttggattttgaactgaccaagacaacagctaaggaagtggctctgttaagaacctattgcattgaagcttcgatatcaaacataaccacggcaacaagatgtccaacgcaaggagagccttatctcaaagaggaacaagaccagcagtacatttgccggagagatgtggtagatagagggtggggcaatggctgtggcttgtttggaaaaggaggagttgtgacatgtgcgaagtttttatgctcggggaagataacaggcaatctggtccaaattgaaaaccttgaatatacggtagttgtgacagtccacaatggagacacccatgcagtaggaaatgacacatccaatcatggagtgacagccacgataactcccaggtcaccatcggtagaagtcaaattgccggactatggagaactaacactcgattgtgaacccaggtccggaattgacttcaatgagatgatcctgatgaaaatgaaaaagaaaacgtggcttgtgcacaagcaatggtttttggacctacctctaccatggacagcaggagcagacacatcagaagttcattggaattataaagagagaatggtgacattcaaagttcctcatgccaagagacaggatgtgacagtgctaggatctcaggagggagctatgcattctgccctcgccggagccacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtacgaaggcgctggagctccgtgtaaagttcccatagagataagagatgtgaacaaggaaaaagtagttgggcgcatcatctcatctaccccttttgctgagaataccaacagcgtaaccaacatagaattagaacccccttttggggacagctacatagtgataggtgttggagatagtgcattaacactccattggttcaggaaagggagctccattggcaagatgtttgagtctacatacagaggtgcaaaacgaatggccattctaggtgaaacagcttgggattttggttctgttggtggactgttcacatcactgggaaaggctgtacaccaagtttttggaagtgtgtatacaaccatgtttggaggggtctcatggatgattagaattctaattgggttcttagtattgtggattggcacgaattcaagaaatacttcaatggcaatgacgtgcatagctgttgggggaatcactctgtttctaggtttcacagttcaagcagacatgggttgtgtggtgtcatggaatgggaaggaactaaaatgtggaagcggaatctttgtggttgacaacgtgcacacttggacagaacagtacaaattccaaccagagtccccagcgaggctagcgtctgcaatattgaatgcccacaaagatggggtctgtggaatcagatcaaccacgaggctggaaaatgtcatgtggaagcaaataaccaacgagctaaactatgttctctgggaaggaggacatgacctcactgtagtggctggggacgtgaaaggggtgttgaccaaaggcaagagagcactcacacctccagtgaatgatctgaaatattcatggaagacatggggaaaagcaaaaatctttaccccagaagcaagaaatagcacatttttaatagacggaccagacacctccgaatgccccaatgaacgaagagcatggaacttttttgaggtagaagactatggatttggcatgtttacgaccaacatatggatgaaattccgagaaggaagttcagaagtgtgtgaccatagattaatgtcggcggcaattaaagatcagaaagctgtgcatgctgacatgggttattggatagagagctcaaaaaaccagacctggcaaatagagaaagcatcccttattgaagtgaaaacatgcctgtggcccaaaacccacacgttgtggagcaatggagtgctggaaagtcagatgctcattccaagatcatatgcaggccctttttcacagcacaattaccgccagggctatgccacgcaaaccgcgggcccatggcacttgggcaaattggagatagactttggagaatgtcccggaacaacagtcacaattcaggaggattgtgaccatagaggcccatctttgaggaccaccacagcatctggaaaactggtcacgcagtggtgctgccgctcctgcacgatgccccccttaaggttcttgggagaagatggatgctggtacgggatggagattaggcccttgagtgaaaaagaagagaacatggtcaaatcacaggtaacagccggacagggtacatcagaaactttttctatggggctgctatgcctgaccctgttcgtggaagaatgcttaaggagaagagtcactaggaaacacatgatattggttgtggtaatcaccttctgtgctatcatcctaggaggtctcacatggatggacttactacgagcccttatcatgttaggggacaccatgtctggtagaataggaggacagattcacctagccatcatggcagtgttcaagatgtcaccaggatatgtgctgggtgtgtttttaaggaaacttacttcaagagagacagcgctaatggtaataggaatggccatgacaacggtgttttcaattccacatgatctcatggaactcattgatggaatatcattggggttgataatactaaaaatagtaacacactttgataacacccaagtgggaactttagccctttccctgactttcataagatcaacaacaccattagtcatggcttggaggaccatcatggctgtgttctttgtggtcacactcattcctttgtgcaggacaagctgtcttcaaaaacagtcccattgggtagaaataacagcacttatcttaggagcccaggctttgccagtgtacctaatgactctcatgaaaggagcctcaagaagatcttggcctcttaatgagggcataatggctgtgggtttggtgagcctcttaggaagcgccctcttaaagaatgatgttcctttagctggcccaatggtggcaggaggcttacttctagcggcttacgtaatgagtggtagctcagcagacctgtcactagagaaggctgctaatgtgcaatgggatgaaatggcggacataactggctcaagcccgatcatagaagtgaagcaggatgaagatggctctttctccatacgggacgtcgaggaaaccaacatgataaccctcttggtgaaactggcgctgataacagtatcaggtctttaccccttggcaattccagttacaatggcactatggtatgtttggcaagtgaaaacacaaagatcaggagctctgtgggacgtcccctcacccgctgccactcagaaagccacactgtctgaaggggtgtataggatcatgcaaagagggttgttcgggaaaactcaggttggagtggggatacacatggaaggtgtattccacacaatgtggcacgtaacaagaggatcagtgatctgccatgagacagggagattagagccatcttgggctgacgtcaggaatgacatgatatcatacggtgggggatggaggctcggagacaagtgggacaaagaagaagatgttcaggtcctagccatagaaccaggaaaaaatcctaaacacgtccaaacgaaaccaggccttttcaagaccctaactggagaaattggagcagtaactctggatttcaaacccggaacgtctggctctcctatcataaacaagaaagggaaagttattggactctatggaaatggggtagttaccaaatcaggtgattacgtcagtgccataacgcaagccgaaagaattggtgagccagattatgaagtggatgaggacatctttcgaaagaaaagattaaccataatggacttacaccccggagccggaaaaacaaaaagaattctcccatcaatagtcagagaagctttgaaaaggaggctgcgaaccttgattctggcccccacgagagtggtggcggccgagatggaagaggccttacgcggactgccaatccgttatcagaccccagctgtgaaatcagagcacacaggaagagagattgtagacctcatgtgtcatgcaaccttcacaacgagacttttgtcatcaaccagggttccaaattataacctcatagtgatggatgaagcacattttactgacccttgtagtgtcgcagctagaggatacatctcaaccagggtggaaatgggagaggcagcagctatcttcatgactgcaacccctcctggatcgatagatcccttcccccagagcaacagcccaatagaagacatcgagagggaaatcccagaaaggtcatggaacacagggttcgactggataacagactaccaagggaaaactgtgtggtttgttcccagcataaaagctggaaatgacattgcaaattgtttgagaaagtcgggaaagagagtgatccagttgagcagaaaaacctttgacacagagtatccaaagacgaaacttacggactgggattttgtggtcaccacagacatatctgaaatgggagccaatttcagagctgggagagtgatagaccccaggagatgcctcaagccagttatcctgacagatgggccagagagagttattctagcaggtccaattccagtaactccagcaagtgccgctcagaggagagggcgaataggtaggaatccagcacaagaagatgaccaatatgttttctccggagacccactaaagaatgatgaagatcatgctcactggacagaagcaaagatgttgcttgacaatatctacactcctgaagggataattccaacgttgtttggtccggaaagggaaaaaacccaagctattgatggagagtttcgcctcagaggggaacaaaggaagacttttgtggaattgatgaggagaggagaccttccggtgtggctgagctataaggtagcttctgccggtatatcttacaaagaccgagaatggtgcttcacaggggaaaggaataaccaaattttagaagaaaacatggaggttgaaatctggactagagagggagaaaagaaaaagctaaggccaaaatggttagatgcacgtgtgtacgctgaccccatggctttgaaggatttcaaggagtttgccagtggaagaaagagcataactcttgacatcctaacagagattgccactttgccaacttacctttcctctaaggccaagctagcccttgacaacatagtcatgctccacacaacagaaaaaggagggagggcctaccaacatgccctgaacgaactcccggagtcactggaaacactcatgcttgtagccctactaggtgctatgacagccggtatcttcctgtttttcatgcaggggaaaggaatagggaaattgtcaatgggtctgatagccatagctgtggctagtggcttgctctgggtagcagaaattcagccccagtggatagcagcttcaatcatactggagttttttcttatggtgctgttgataccagaaccagaaaaacaaaggaccccacaagacaatcaattgatctacgttatattgaccattctcaccatcattggtcttatagcagctaatgagatggggctgattgaaaaaacaaaaacggactttgggttctaccaggtaaaaacagaaaccaccattcttgatgtggatttgagaccagcctcagcgtggacactctatgcagtggccaccactattctgactcccatgctgagacacaccatagagaacacgtctgccaacctatctctagcagccattgccaaccaagcagctgtcctaatgggacttggaaaaggatggccgctccacaggatggacctcggtgtgccgctgctagcaatgggatgttattctcaagtgaacccaacaaccttgacagcatccctagttatgcttttagttcattatgccataataggtccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaagtcatgctactagtcctgtgtgttggacaattacttttgatgagaacaacatgggctctctgcgaagtgctgactctggccacaggaccagtcatgaccttgtgggagggcaacccgggaaggttttggaacacaaccatagctgtatccacagctaacatttttagaggaagctacttggcgggagctggactagctttttcgctcataaagaatgcacaaacccctaggaggggaactgggaccacaggagagacactgggagagaagtggaagagacagctaaactcattagacagaaaagagtttgaagagtacaaaagaagtggaatactagaagtagataggactgaagccaagtctgccctaagagatggatccaaaatcaagtatgcggtgtccagagggtctagtaagatcagatggattgttgaaagaggaatgataaaaccaaaaggaaaggtcgtagatcttggttgcgggaggggaggatggtcctattacatggcgacactcaagaacgtgactgaagtgaaaggatatactaaaggaggtccaggacatgaagaaccaatccccatggctacttatggctggaatttggtcaaactccattcaggagttgatgtgttctacaaacccacagagcaggtggacaccctgctttgtgacattggggagtcatcctctaatccgacaatagaggaaggaagaacattgagagtcttgaagatggtggagccatggctctcttcaaaacctgagttctgcatcaaagtcctcaatccctacatgccgacagttatagaggagctggagaaactgcagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacaatcattgggagaaggcttcagagattgcgagaagagcacaaagaaacctggcactatgaccaggaaaacccatacagaacctgggcgtatcatggaagctatgaagccccttcgacaggctcagcatcctccatggtgaacggggtagtaaaactgctgacaaaaccttgggatgtgattccaatggtgactcagttggccatgacagacacaaccccttttggacaacaaagagtattcaaggagaaggtggataccagaacaccacaaccaaaacccggcacacggatgattatgactacgacagccaattggttgtgggccctcctcgggaagaagaaaagtcctagactgtgcacaagggaagagttcatctcaaaagttaggtcaaatgcagccataggcgcagtctttcaggaagaacagggatggacatcagccagtgaggctgtgaatgacagccggttctgggaactggttgacaaagaaagggctctgcaccaggaaggaaaatgtgaatcgtgtgtctacaacatgatgggaaagcgtgagaaaaaattaggagagtttggtagggccaagggaagccgagcaatctggtacatgtggctgggggcgcggttcctggaatttgaagccctgggttttttgaatgaagatcactggtttagcagagaaaactcatggagtggagtggaaggggaaggtctgcatagattgggatacatcttggaggacatagacaagaaggatggagacctgatatatgctgacgacacagcaggctgggacacgagaatcactgaagatgaccttttaaatgaagaactgatcacagaacagatggcccctcaccacaagaccctagccaaagccattttcaaactaacctatcaaaacaaagtggtgaaagttctcagacccacaccgaaaggagcggtaatggacattatatccaggaaagaccaaagaggtagtggacaggttggaacatatggtttaaacacattcactaacatggaagtccaactcatccgccaaatggaagctgaaggagtcatcacacaagacgacatgcagaacccaaaagggttgaaagaaagagtcgagaaatggctgaaagagtgcggcgtcgacaggttgaagaggatggcaatcagtggagatgattgcgtggtgaagcccttagatgagaggtttagcacctccctcctcttcttgaatgatatgggaaaggtgaggaaagatatcccgcagtgggaaccatccaagggatggaaaaactggcaagaggttcctttttgctcccaccatttccacaagatcttcatgaaagatggccgctcactggttgttccatgcagaaacccggatgaactgataggaagagccagaatctcgcagggggctggatggagcttgagagaaacagcctgtctgggcaaagcttacgcccagatgtggtcgcttatgtatttccatagaagggacctgcgcctagcctccatggccatatgctcagcagttccaacagaatggtttccaacaagcagaacaacatggtcaatccacgctcatcaccagtggatgaccactgaagatatgcttaaagtgtggaacagagtgtggatagaagataaccctaatatgactgacaagactccagtccattcgtgggaagacataccttacctagggaaaagagaggatctgtggtgcggatccctgattggactttcttccagagccacctgggcgaagaacattcacacggccataacccaggtcaggaatctgatcggaaaagaggaatacgtggattacatgccagccatgaaaagatacagcgctcctttcgagagtgaaggagttctgtaa

SEQ ID NO: 7856 - RNA, 9867 nt, synthetic construct
  misc_feature 1..9867: note = derived and/or modified CDS sequence (wt) from DENV-4__KC762697__SS-prME
  source 1..9867: mol_type = other RNA
tcaacaatgacattgctgtgtttgattcccaccgcaatggcgtttcacctgtcaacaagagacggcgaacccctcatgatagtggcaaaacacgaaagggggagacctctcttgtttaagacaacagaaggaatcaataaatgcaccctcatagccatggacctgggtgaaatgtgtgaagacactgtcacgtataaatgtcctctattagttaacaccgaacctgaagacattgattgctggtgcaatctcacgtccacctgggttatgtacgggacatgcacccagagcggagaacggaggcgagagaagcgctcagtagctttaacaccacattcaggaatgggattggaaacaagagctgagacatggatgtcatcggaaggggcttggaaacatgctcagagagtggaaagctggatactcagaaacccaggattcgcgcttctggcaggatttatggcttacatgattgggcaaacaggaatccagcgaactgttttctttgtcctaatgatgctagttgccccatcctacggaatgcgatgcgtaggggtagggaacagagactttgtggaaggagtctcgggtggagcatgggtcgacttggtgctagaacatggaggatgtgtcacaaccatggcccagggaaaaccaaccttggattttgaactgaccaagacaacagctaaggaagtagctctgttaagaacctattgcattgaagcctcgatatcgaacataaccacggcaacaagatgtccaacgcaaggagagccttatctcaaagaggaacaagaccaacagtacatttgccggagagacgtggtagacagagggtggggcaatggctgtggcttgtttggaaaaggaggagttgtgacatgtgcgaagtttttatgctcggggaagataacaggcaatctggtccaaattgaaaaccttgaatatacggtagttgtgacagtccacaatggagacacccatgcagtaggaaatgacacatccaatcatggagtgacagctacgataactcccaggtcaccatcggtagaagttaaattgccggactatggagaactaacactcgattgtgaacccaggtccggaattgatttcaatgagatgatcctgatgaaaatgaaaaagaaaacgtggcttgtgcacaagcaatggtttttggacctacctctaccgtggacagcaggagcagacacatcagaagtccattggaattataaagagagaatggtgacattcaaagttcctcatgccaagagacaggatgtgacagtgctaggatctcaggagggagctatgcattctgccctcgccggagccacagaagtggattctggtgatggaaatcacatgtttgcaggacatctcaagtgcaaagttcgtatggagaaattgagaattaagggaatgtcatacacgatgtgttcagggaagttctcaattgacaaagagatggcagaaacacagcatgggacaacagtggtgaaagtcaagtatgaaggcgctggagccccatgtaaagttcccatagagataagagatgtgaacaaggaaaaagtagttgggcgcatcatctcatccaccccttttgccgagaataccaacagcgtaaccaacatagaattagaacccccttttggggacagctacatagtgataggtgttggagatagtgcattaacactccattggttcaggaaagggagctccattggcaagatgtttgagtccacatacagaggtgcaaaacgaatggccattctaggtgaaacagcttgggattttggctctgttggtggactgtttacatcactgggaaaggctgtacaccaagtttttggaagtgtgtatacaaccatgtttggaggggtctcatggatgatcagaatcctaattgggctcttagtattgtggattggcacgaattcaagaaacacttcaatggcaatgacgtgcatagctgttggaggaatcactctgtttctaggtttcacagttcaagcagacatgggttgtgtggtgtcatggaatgggaaggaactaaaatgtggaagcggaatttttgtggttgacaatgtgcatacttggacagaacagtacaaattccaaccagagtccccagcgaggctagcttctgcaatattgaatgcccacaaagatggggtctgtggaatcagatcaaccacgaggctggaaaatgttatgtggaagcaaataaccaacgagctaaactatgttctctgggaaggaggacatgacctcactgtagtggccggggacgtgaagggggtgttgaccaaaggcaagagagtactcacacctccagtgaatgatctgaaatattcatggaagacatgggggaaagcaaaaatcttcaccccagaagcaagaaatagcacatttttaatagacggaccagacacctccgaatgccccaatgaacgaagagcatggaacttttttgaggtagaagactatggatttggcatgttttcgaccaacatatggatgaaattccgagaaggaagctcagaagtgtgtgatcatagattaatgtcggcggcaatcaaagatcagaaagctgtgcatgctgacatgggttattggatagagagctcaaaaaaccagacctggcagatagagaaagcatcccttattgaagtgaaaacatgtctgtggcccaaaacccacacgctgtggagcaatggagtgctggaaagtcagatgctcattccaagatcatatgcaggccctttttcacagcacaattaccgccagggctatgccacgcaaatcgcgggcccatggcacttaggcaaattggagatagactttggagaatgccccggaacaacagtcacgattcaggaggattgtgaccatagaggcccatctttgaggaccaccactgcatctggaaaactggtcacgcaatggtgctgccgctcctgcacgatgcctcccttaaggttcttgggagaagatggatgttggtatgggatggagattaggcccttgagtgaaaaagaagagaacatggtcaaatcacaggtgacagccggacagggtacatcagaaactttttctatggggttgttatgcctgaccttgttcgtggaagagtgcttaaggagaagagtcactaggaaacacatgatattggttgtggcaattaccttctgtgctatcatcttaggaggcctcacatggatggacttactacgagcccttatcatgttaggggacactatgtctggtagaataggaggacagattcacctagccattatggcagtgttcaagatgtcaccaggatatgtgctgggtgtgtttttaaggaaacttacttcaagagagacagcgctaatggtaataggaatggccatgacaacggtgttttcaattccacatgacctcatggaactcattgatggaatatcattggggttgatattgctaaaaatagtaacacactttgatgacacccaagtgggaaccttagccctttccttgactttcataagatcaacaacaccattagtcatggcttggaggacaatcatggctgtgttctttatggtcacactcattcctttgtgcaggacaagctgtcttcaaaaacagtcccattgggtagaaataacagcacttatcttaggagcccaggctttgccagtgtacctaatgactctcatgaaaggagcctcaagaagatcttggcctcttaatgagggcataatggctgtgggtttggtgagcctcttaggaagcgccctcctaaagaatgatgttcctttagctggcccaatggtggcaggaggcttacttctagcggcttacgtaatgagtggtagctcagcagacctgtcactagagaaggctgccaatgtgcagtgggatgaaatggcggacataactggctcaagcccaatcatagaagtgaagcaggatgaagatggctctttttccatacgggatgtcgaggaaaccaacatgataaccctcttggtgaaactggcgctgataacagtatcaggtctttaccctttggcaattccagtcacaatggcactatggtatatttggcaagtgaaaacacaaagatcaggagctctatgggacgtcccctcacctgctgccactcagaaagccacactgtctgaaggggtgtataggatcatgcaaagagggttgtttggaaaaactcaggttggagtagggatacacatggaaggtgtattccacacaatgtggcacgtgacaagaggatcagtgatctgccatgagacagggagattggagccatcttgggctgacgtcaggaatgacatgatatcatacggtgggggatggaggctcggagacaaatgggacaaagaagaagacgttcaggtcctagccatagaaccaggaaaaaatcctaaacatgtccaaacgaaaccaggccttttcaagaccctaactggagaaattggagcagtaactctggatttcaaacccggaacgtctggctctcccatcattaacaagaaagggaaagttattggactctatggaaatggagtagttaccaaatcaggtgattacgtcagtgccataacgcaagccgaaagaattggtgagccagattatgaagtggatgaggacatttttcgaaagaaaagattaactataatggacttacaccctggagctggaaagacaaaaagaattctcccatcaatagtcagagaagctttgaaaaggaggctgcgaaccttgattttggctcccacgagagtggtggcggccgagatggaagaggccctacgcggactgccaatccgttaccagaccccagctgtgaaagcagagcacacaggaagagagattgtagacctcatgtgtcatgcaaccttcacaacgcgacttctgtcatcaaccagggttccaaattataacctcatagtgatggatgaagcacatttcactgacccttgtagtgtcgcggctagaggatacatttcaaccagggtggagatgggagaggcagcagctatctttatgactgcaacccctcctggatcgacagatccctttccccagagcaacagcccaatagaagacatcgagagggaaatcccagaaaggtcatggaacacagggttcgactggataacagactaccaagggaaaactgtgtggttcgttcctagcataaaagctggaaatgacattgcaaattgtttgagaaagtcgggaaagagagtgatccagttgagcagaaaaacctttgacacagagtatccaaagacgaaactcacggactgggattttgtggtcaccacagacatatctgaaatgggggccaatttcagagctgggagagtgatagaccccaggagatgcctcaagccagttatcctaacagatgggccagagagagttattctagcaggcccaattccagtaactccagcaagtgccgctcagagaagagggcgaataggtcggaatccagcgcaagaagatgaccaatatgttttctccggagacccactaaagaatgatgaagatcatgctcactggacagaagcaaagatgttgcttgacaatatctacacccctgaagggataattccaacattgtttggtccggaaagggaaaaaacccaagccattgatggagagtttcgcctcagaggggaacaaaggaagacttttgtggaattgatgaggagaggagaccttccggtgtggctgagctacaaggtagcttctgccggcatctcttacaaagaccgagaatggtgcttcacaggggaaaggaataaccaaattttagaagaaaacatggaggttgaaatctggactagagagggagaaaagaaaaaactaaggccaaaatggttagatgcacgtgtgtacgctgaccccatggctctaaaggatttcaaggagtttgccagtggaagaaagagcataacccttgacatcctaacagagattgccactttgccaacttacctttcctctaaggccaagctagcccttgacaacatagtcatgctccacacaacagaaaagggagggagggcctaccaacacgccttgaacgaactcccggagtcactggaaacactcatgcttgtagccctactaggtgctatgacagccggcatcttcctgtttttcatgcaggggaaaggaataggaaaattgtcaatgggtctgatagccatagctgtggctagtggcttgctctgggtagcagaaattcagccccagtggatagcagcttcaatcatactggagttttttcttatggtgctgttgataccagaaccagaaaaacaaaggaccccacaagacaatcaattgatctacgttatattgaccattctcaccattattggtctcatagcagccaatgagatggggctgattgaaaaaactaaaacggactttgggttctaccaggcaaaaacagaaaccaccattcttgatgtggatttgagaccagcctcagcatggacactctatgcagtggccaccactattctgactcccatgctgagacacaccatagagaacacgtctgccaacctatctctagcagccattgccaaccaagcagctgtcctaatgggacttggaaaaggatggccgctccacagaatggacctcggtgtgccgctgttagcaatgggatgttattctcaagtgaacccaacaaccctgacagcatccctagtcatgcttttagtccattatgccataataggtccaggattgcaggcaaaagccacaagagaggcccagaaaaggacagctgctgggatcatgaagaaccccacggtggacgggataacagtaatagatctagaaccaatatcctatgacccaaaatttgaaaagcaattagggcaagtcatgctactagtactatgtgttggacaattacttttgatgagaacaacatgggctctctgcgaagtattgactttggcaacaggaccaatcatgaccttgtgggagggcaacccgggaaggttttggaacacgaccatagctgtatcaacagctaacatttttagaggaagctacttggcgggagctggactagctttttcgctcataaagaatgcacaaacccccaggaggggaactgggaccacaggagagacactgggagagaagtggaagagacagctaaactcattagacagaaaagagtttgaagaatacaaaagaagtggaatactagaagtggataggactgaagccaagtctgccctaagagatggatctaagatcaagtatgcggtgtccagagggtctagtaagatcagatggattgttgaaagagggatggtaaagccaaaaggaaaggtcgtggatcttggttgcgggaggggaggatggtcctattacatggcaacactcaagaacgtgactgaagtgaaaggatacacaaaaggaggtccaggacatgaagaaccaatccccatggctacttatggctggaatttggtcaaactccattcaggggttgatgtgttctacaaacccactgagcaggtggacaccctgctctgtgacattggggagtcatcctctaatccaacaatagaggaaggaagaacactgagagtcttgaagatggtggagccatggctctcttcaaaacctgagttctgcatcaaagtcctcaacccctacatgccgacagttatagaagagctggaaaaactgcagagaagacatggtggaagcctcgtcagatgtccgctatctaggaattctacccatgagatgtactgggtgtcaggtgcgtcgggaaacatcgtgagttctgtgaacacaatatcaaagatgctgttgaacaggttcacaacaaggcataggaaacccacttatgagaaggacgtagatcttggggcgggaacgagaagtgtctccactgaaacagaaaaaccagacatgacaatcattgggagaaggcttcagagattgcgagaagagcacaaagaaacctggcactatgaccaggaaaacccatacagaacctgggcgtatcatggaagttatgaagctccttcgacaggctcagcatcttccatggtgaacggggtagtaaaactgctgacaaaaccttgggatgtgattccaatggtgacccagttggccatgacagacacaaccccttttgggcaacaaagagtgttcaaagagaaggtggataccagaacaccacaaccaaaacccggcacacgaatgattatgaccacgacagccaattggttgtgggccctcctcgggaagaagaaaagtcccagactgtgcacaagggaagagttcatctcaaaagttaggtcaaatgcagccataggcgcagtctttcaggaagaacagggatggacatcagccagtgaagctgtgaatgacagccggttctgggaactggttgacaaagaaagggctctgcaccaggaaggaaaatgtgaatcgtgtgtctataacatgatgggaaaacgtgagaaaaaactgggagagtttggtagggctaagggaagccgagcaatctggtacatgtggctgggggcgcggttcctggaatttgaagccctgggttttttgaatgaagatcactggtttagcagagaaaactcatggagtggagtggaaggggaaggtctgcacagattgggatacatcttggaggacatagacaagaaggatggagacctgatatatgctgacgacacagcaggctgggacacgagaatcactgaggatgaccttttaaatgaagaactgatcacagaacagatggcccctcaccacaagaccttagccaaagccattttcaaactaacctatcaaaacaaagtggtgaaagtcctcagacccacaccgaaaggagcggtaatggacattatatccaggaaagaccaaagaggtagtggacaggttggaacatatggtttaaacacattcactaacatggaagttcaactcatccgccaaatggaagctgaaggagtcatcacacaagacgacatgcagaacccaaaagggttggaagaaagagttgagaaatggctgaaagagtgtggcgtcgacaggttaaagaggatggcaatcagtggagatgattgcgtggtgaagcccttagatgagaggtttagcacctccctcctcttcttgaatgacatgggaaaggtgaggaaagacatcccgcagtgggaaccatccaagggatggaaaaactggcaagaggttcctttttgctcccaccattttcacaagatcttcatgaaagatggccgctcactggtcgttccatgcagaaaccaggatgaactgataggaagagccagaatctcgcagggggctggatggagcttgagagaaacagcctgtctgggcaaagcttacgcccagatgtggtcgcttatgtacttccatagaagggacctgcgcctagcctccatggccatatgctcagcagttccaacagaatggtttccaacaagcagaacaacatggtcaatccacgctcaccaccagtggatgaccactgaagatatgcttaaagtgtggaacagagtgtggatagaagacaaccccaatatgactgacaagactccaatccattcgtgggaagacataccttacctagggaaaagagaggatctgtggtgtggatctctgattggactttcttccagagccacctgggcgaagaacattcacacggccataactcaggtcaggaatctgatcggaaaagaggaatacgtggattacatgccagtcatgaaaagatacagcgctccttccgagagtgaaggagttctgtaa

SEQ ID NO: 7857 - RNA, 9867 nt, synthetic construct
  misc_feature 1..9867: note = derived and/or modified CDS sequence (wt) from DENV-4__KC762698__SS-prME
  source 1..9867: mol_type = other RNA
tcaacaatgacattgctgtgtttgattcccaccgtaatggcgtttcacctgtcaacaagagatggcgaacccctcatgatagtggcaaaacacgaaagggggagacctctcttgtttaagacaacagaaggaatcaacaaatgcaccctcattgccatggacctgggtgaaatgtgtgaagacactgtcacgtataaatgtcctctactggtcaacaccgaacctgaagacattgtttgctggtgcaatctcacgtccacctgggtcatgtacgggacatgtacccagagcggagaacggaggcgagaaaagcgctcagtagctttaacaccacattcaggaatgggattggaaacaagagctgagacatggatgtcatcggaaggggcctggaaacatgctcagagagtggaaagctggatactcagaaacccaggattcgcgctcctggcaggatttatggcttacatgattgggcaaacaggaatccagcgaactgttttctttgtcctaatgatgctagtcgccccatcctacggaatgcgatgcgtaggggtagggaacagagactttgtggaaggagtctcgggtggagcatgggtcgacttggtgctagaacatggaggatgcgtcacaaccatggcccagggaaaaccaaccttggattttgaactgaccaagacaacagccaaggaagtggctctgctaagaacctattgcattgaagcttcgatatcaaacataaccacggcaacaagatgcccaacgcaaggagagccttatctcaaagaggaacaagaccagcagtacatttgccggagagatgtggtagatagagggtggggcaatggctgtggcttgtttggaaaaggaggagttgtgacatgtgcgaagtttttatgttcggggaagataacaggcaatctggtccaaattgaaaaccttgaatatacggtagttgtgacagtccacaatggagacacccatgcagtaggaaatgacacatccaatcatggagtgacagccacgataactcccaggtcaccatcggtagaagtcaaattgccggactatggagaactaacactcgattgtgaacccaggtccggaattgacttcaatgagatgatcctgatgaaaatgaaaaagaaaacgtggcttgtgcacaagcaatggtttttggacctacctctaccatggacagcaggagcagacacatcagaagttcattggaattataaagagagaatggtgacattcaaagttcctcatgccaagagacaggatgtgacagtgctaggatctcaggagggagctatgcattctgccctcgccggagccacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtacgaaggcgctggagctccgtgtaaagttcccatagagataagagatgtgaacaaggaaaaagtagttgggcgcatcatctcatctaccccttttgctgagaataccaacagcgtaaccaacatagaattagaacccccttttggggacagctacatagtgataggtgctggagatagtgcattaacactccattggttcaggaaagggagctccattggcaagatgtttgagtccacatacagaggtgcaaaacgaatggccattctaggtgaaacagcttgggattttggttctgttggtggactgttcacatcactgggaaaggctgtacaccaagtttttggaagtgtgtatacaaccatgtttggaggggtctcatggatgattagaattctaattgggttcttagtattgtggattggcacgaattcaagaaatacttcaatggcaatgacgtgcatagctgttgggggaatcactctgtttctaggtttcacagttcaagcagacatgggttgtgtggtgtcatggaatgggaaggaactaaaatgtggaagcggaatctttgtggttgacaacgtgcacacttggacagaacagtacaaattccaaccagagtccccagcgaggctagcgtctgcaatattgaatgcccacaaagatggggtctgtggaatcagatcaaccacgaggctggaaaatgtcatgtggaagcaaataaccaacgagttaaactatgttctctgggaaggaggacatgacctcactgtggtggctggggacgtgaaaggggtgttgaccaaaggcaagagagcactcacacctccagtgaatgatctgaaatattcatggaagacatggggaaaagcaaaaatctttaccccagaagcaagaaatagcacatttttaatagacggaccagacacctccgaatgccccaatgaacgaagagcatggaacttttttgaggtagaagactatggatttggcatgttcacgaccaacatatggatgaaattccgagaaggaagttcagaagtgtgtgaccatagattaatgtcggcggcaattaaagatcagaaagctgtgcatgctgacatgggttattggatagagagctcaaaaaaccagacctggcaaatagagaaagcatcccttattgaagtgaaaacatgcctgtggcccaaaacccacacgttgtggagcaatggagtgctggaaagtcagatgctcattccaagatcatatgcaggtcctttttcacagcacaattaccgccagggctatgccacgcaaaccgcgggcccatggcacttgggcaaattggagatagactttggagaatgtcccggaacaacagtcacaattcaggaggattgtgaccatagaggcccatctttgaggaccaccactgcatctggaaaactggtcacgcagtggtgctgccgctcctgcacgatgccccccttaaggttcttgggagaagatggatgctggtacgggatggagattaggcccttgagtgaaaaagaagagaacatggtcaaatcacaggtaacagccggacagggtacatcagaaactttttctatggggctgctatgcctgaccttgttcgtggaagaatgcttaaggagaagagtcactaggaaacacatgatattggttgtggtaatcaccttctgtgctatcatcctaggaggtctcacatggatggacttactacgagcccttatcatgttaggggacactatgtctggtagaataggaggacagattcacctagccatcatggcagtgttcaagatgtcaccaggatatgtgctgggtgtgtttttaaggaaacttacttcaagagagacagcgctaatggtaataggaatggccatgacaacggtgttttcaattccacatgatctcatggagctcattgatggaatatcattggggttgatattactaaaaatagtaacacactttgataacacccaagtgggaactttagccctttccctgactttcataagatcaacaacaccattagtcatggcttggaggaccatcatggctgtgttttttgtggtcacactcattcctttgtgcaggacaagctgtcttcaaaaacagtcccattgggtagaaataacagcacttatcttaggagcccaggctttgccagtgtacctaatgactctcatgaaaggagcctcaagaagatcttggcctcttaatgagggcataatggctgtgggtttggtgagcctcttaggaagcgccctcttaaaaaatgatgttcctttagctggcccaatggtggcaggaggcttacttctagcggcttacgtaatgagtggtagctcagcagacctgtcactagagaaggctgccaatgtgcaatgggatgaaatggcggacataactggctcaagcccaatcatagaagtgaagcaggatgaagatggctctttctctatacgggacgtcgaggaaaccaacatgataaccctcttggtgaaactggcgctgataacagtatcaggtctttaccccttggcaattccagtcacaatggcactatggtatgtttggcaagtgaaaacacaaagatcaggagctctgtgggacgtcccctcacccgctgccactcagaaagccacactgtctgaaggggtgtataggatcatgcaaagagggttgttcgggaaaactcaggttggagtggggatacacatggaaggtgtattccacacaatgtggcacgtaacaagaggatcagtgatctgccatgagacagggagattagagccatcttgggctgacgtcaggaatgacatgatatcatacggtgggggatggaggctcggagacaagtgggacaaagaagaagatgttcaggtcctagccatagaaccaggaaaaaatcctaaacatgtccaaacgaaaccaggccttttcaagaccctaactggagaaattggagcagtaactctggatttcaaacccggaacgtctggctctcctatcataaacaagaaagggaaagttattggactctatggaaatggagtagttaccaaatcaggtgattacgtcagtgccataacgcaagccgaaagaattggtgagccagattatgaagtggatgaggacatctttcgaaagaaaagattaaccataatggacttacaccccggagccggaaaaacaaaaagaattctcccatcaatagtcagagaagctttgaaaaggaggctgcgaaccttgattctggcccccacgagagtggtggcggccgagatggaagaggccttacgcggactgccaatccgttatcagaccccagctgtgaaatcagagcacacaggaagagagattgtagacctcatgtgtcatgcaaccttcacaacgagacttttgtcatcaaccagggttccaaattataacctcatagtgatggatgaagcacattttactgacccttgtagtgtcgcagctagaggatacatctcaaccagggtggaaatgggagaggcagcagctatcttcatgactgcaacccctcctggatcgatagatcccttcccccagagcaacagcccaatagaagacatcgagagggaaatcccagaaaggtcatggaacacagggttcgactggataacagactaccaagggaaaactgtgtggtttgttcccagcataaaagctggaaatgacattgcaaattgtttgagaaagtcgggaaagaaagtgatccagttgagcagaaaaacctttgacacagagtatccaaagacgaaactcacggactgggattttgtggtcaccacagacatatctgaaatgggagccaatttcagagctgggagagtgatagaccccaggaggtgcctcaagccagttatcctaacagatgggccagagagagttattctagcaggtccaattccagtaactccagcaagtgccgctcagaggagagggcgaataggtaggaatccagcacaagaagatgaccaatatgttttctccggagacccactaaagaatgatgaagatcatgctcactggacagaagcaaagatgttgcttgacaatatctacactcctgaagggataattccaacattgtttggtccggaaagagaaaaaacccaagctattgatggagagtttcgcctcagaggggaacaaaggaagacttttgtggaattgatgaggagaggagaccttccggtgtggctgagctacaaggtagcttctgccggcatatcttacaaagaccgagaatggtgcttcacaggggaaaggaataaccaaattttagaagaaaacatggaggttgaaatctggactagagagggagaaaagaaaaagctaaggccaaaatggttagatgcacgtgtgtacgctgaccccatggccttgaaggatttcaaggagtttgccagtggaagaaagagcataactcttgacatcctaacagagattgccactttgccaacttacctttcctctaaggccaagctagcccttgacaacatagtcatgctccacacaacagaaaaaggagggagggcctaccaacatgccctgaacgaactcccggagtcactggaaacactcatgcttgtagccctactaggtgctatgacagccggtatcttcctgtttttcatgcaggggaaaggaatagggaaattgtcaatgggtctgatagccatagctgtggctagtggcttgctctgggtagcagaaattcagccccagtggatagcagcttcaatcatactggagttttttcttatggtgctgttgataccagaaccagaaaaacaaaggaccccacaagacaatcaattgatctacgttatattgaccattctcaccattattggtcttatagcagccaatgagatggggctgattgaaaaaacaaaaacggactttgggttctaccaggtaaaaacagaaaacaccattcttgatgtggatttgagaccagcctcagcgtggacactctatgcagtggccaccactattctgactcccatgctgagacacaccatagagaacacgtctgccaacctatctctggcagccattgccaaccaagcagctgtcctaatgggacttggaaaaggatggccgctccacaggatggacctcggtgtgccgctgctagcaatgggatgttattctcaagtgaacccaacaaccttgacagcatccctagttatgcttttagttcattatgctataatagggccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaagtcatgctactagtcctgtgtgttggacaattacttttgatgagaacaacatgggctctctgcgaagtactgactctggccacaggaccagtcatgaccttgtgggagggcaacccgggaaggttttggaacacaaccatagctgtatccacagctaacatttttagaggaagctacttggcgggagctggactagctttttcgctcataaagaatgcacaaacccctaggaggggaactgggaccacaggagagacactgggagagaagtggaagagacagctaaactcattagacagaaaagagtttgaagagtacaaaagaagtggaatactagaagtggataggactgaagccaagtctgccctaagagatggatccaaaatcaagtatgcggtgtccagagggtctagtaagatcagatggattgttgaaagaggaatgataaaaccaaaaggaaaggtcgtagatcttggttgcgggaggggaggatggtcctattacatggcgacactcaagaacgtgactgaagtgaaaggatatactaaaggaggtccaggacatgaagaaccaatccccatggctacttatggctggaatttggtcaaactccattcaggagttgatgtgttctacaaacccacagagcaggtggacaccctgctttgtgacattggggagtcatcctctaatccgacaatagaggaaggaagaacattgagagtcttgaagatggtggagccatggctctcttcaaaacctgagttctgcatcaaagtcctcaacccctacatgccgacagttatagaagagctggagaaactgcagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaatagaaaaaccagacatgacaatcattgggagaaggcttcagagattgcgagaagagcacaaagaaacctggcactatgaccatgaaaacccatacagaacctgggcgtatcatgggagctatgaagccccttcgacaggttcagcatcctccatggtgaacgggatagtaaaactgctgacaaaaccttgggatgtgattccaatggtgactcagttggccatgacagacacaaccccttttgggcaacaaagagtgttcaaggagaaggtggataccagaacaccacaaccaaaacccggcacacggatgatcatgaccacgacagccaattggttgtgggccctcctcgggaagaagaaaagtcccagactgtgcacaagggaagagttcatctcgaaagttaggtcaaatgcagccataggcgcagtctttcaggaagaacagggatggacatcagccagtgaagctgtgaatgacagccggttctgggaactggttgacaaagaaagggctctgcaccaggaaggaaaatgtgaatcgtgtgtctacaacatgatgggaaaacgtgagaaaaaattaggagagtttggtagggccaagggaagccgagcaatttggtacatgtggctgggggcgcggttcctggaatttgaagccctgggttttttgaatgaagatcactggtttagcagagaaaactcatggagtggagtggaaggggaaggtctgcacagattgggatacatcttggaggacatagacaagaaggatggagacctgatatatgctgacgacacagcaggctgggacacgagaatcactgaagatgaccttttaaatgaagaactgatcacagaacagatggcccctcaccacaagaccctagccaaagccattttcaaactaacctatcaaaacaaagtggtgaaagttctcagacccacaccgaaaggagcggtaatggacattatatccaggaaagaccaaagaggtagtggacaggttggaacatatggtttaaacacattcactaacatggaagtccaactcatccgccaaatggaagctgaaggagtcatcacacaagacgacatgcagaacccaaaagggttgaaagaaagagtcgagaaatggctgaaagagtgtggcgtcgacaggttggagaggatggcaatcagtggagatgattgcgtggtgaagcccttagatgagaggtttagcacctccctcctcttcttgaatgatatgggaaaggtgaggaaagatatcccgcagtgggaaccatccaagggatggaaaaactggcaagaggttcctttttgctcccaccatttccacaagatcttcatgaaagatggccgctcactggttgttccatgcagaaaccaggatgaactaataggaagagccagaatctcgcagggggctggatggagcttgagagaaacagcctgtctgggcaaagcttacgctcagatgtggttgcttatgtatttccatagaagggacctgcgcctagcctccatggccatatgctcagcagttccaacagaatggtttccaacaagcagaacaacatggtcaatccacgctcatcaccagtggatgaccactgaagatatgcttaaagtgtggaacagagtgtggatagaagataaccccaatatgactgacaagactccagtccattcgtgggaagacataccttacctagggaaaagagaggatctgtggtgcggatccctgattggactttcttccagagccacctgggcgaagaacattcacacggccataacccaggtcaggaatctgatcggaaaagaggaatacgtggattacatgccagccatgaaaagatacagcgctcctttcgagagtgaaggagttctgtaa

SEQ ID NO: 7858 - RNA, 9867 nt, synthetic construct
  misc_feature 1..9867: note = derived and/or modified CDS sequence (wt) from DENV-4__KC762699__SS-prME
  source 1..9867: mol_type = other RNA
tcaacaatgacattgctgtgtttgattcccaccgtaatggcgtttcacctgtcaacaagagatggcgaacccctcatgatagtggcaaaacacgaaagggggagacctctcttgtttaagacaacagaaggaatcaacaaatgcaccctcattgccatggacctgggtgaaatgtgtgaagacactgtcacgtataaatgtcctctactggtcaacaccgaacctgaagacattgattgctggtgcaatctcacgtccacctgggtcatgtacgggacatgtacccagagcggagaacggaggcgagaaaagcgctcagtagctttaacaccacactcaggaatgggattggaaacaagagctgagacatggatgtcatcggaaggggcttggaaacatgctcagagagtggaaagctggatactcagaaacccaggattcgcgctcctggcaggatttatggcttacatgattgggcaaacaggaatccagcgaactgttttctttgtcctaatgatgctagtcgccccatcctacggaatgcgatgcgtaggggtagggaacagagactttgtggaaggagtctcgggtggagcatgggtcgacttggtgctagaacatggaggatgcgtcacaaccatggcccagggaaaaccaaccttggattttgaactgaccaagacaacagctaaggaagtggctctgttaagaacctattgcattgaagcttcgatatcaaacataaccacggcaacaagatgtccaacgcaaggagagccttatctcaaagaggaacaagaccagcagtacatttgccggagagatgtggtagatagagggtggggcaatggctgtggcttgtttggaaaaggaggagttgtgacatgtgcgaagtttttatgctcggggaagataacaggcaatctggtccaaattgaaaaccttgaatatacggtagttgtgacagtccacaatggagacacccatgcagtaggaaatgacacatccaatcatggagtgacagccacgataactcccaggtcaccatcggtagaagtcaaattgccggactatggagaactaacactcgattgtgaacccaggtccggaattgacttcaatgagatgatcctgatgaaaatgaaaaagaaaacgtggcttgtgcacaagcaatggtttttggacctacccctaccatggacagcaggagcagacacatcagaagttcattggaattataaagagagaatggtgacattcaaagttcctcatgccaagagacaggatgtgacagtgctaggatctcaggagggagctatgcattctgccctcgccggagccacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtacgaaggcgctggagctccgtgtaaagttcccatagagataagagatgtgaacaaggaaaaagtagttgggcgcatcatctcatctaccccttttgctgagaataccaacagcgtaaccaacatagaattagaacccccttttggggacagctacatagtgataggtgttggagatagtgcattaacactccattggttcaggaaagggagctccattggcaagatgtttgagtccacatacagaggtgcaaaacgaatggccattctaggtgaaacagcttgggattttggttctgttggtggactgttcacatcactgggaaaggctgtacaccaagtttttggaagtgtgtatacaaccatgtttggaggggtctcatggatgattagaattctaattgggttcttagtattgtggattggcacgaattcaagaaatacttcaatggcaatgacgtgcatagctgttgggggaatcactctgtttctaggtttcacagttcaagcagacatgggttgtgtggtgtcatggaatgggaaggaactaaaatgtggaagcggaatctttgtggttgacaacgtgcacacttggacagaacagtacaaattccaaccagagtccccagcgaggctagcgtctgcaatattgaatgcccacaaagatggggtctgtggaatcagatcaaccacgaggctggaaaatgtcatgtggaagcaaataaccaacgagctaaactatgttctctgggaaggaggacatgacctcactgtagtggctggggacgtgaaaggggtgttgaccaaaggcaagagagcactcacacctccagtgaatgatctgaaatattcatggaagacatggggaaaagcaaaaatctttaccccagaagcaagaaatagcacatttttaatagacggaccagacacctccgaatgccccaatgaacgaagagcatggaacttttttgaggtagaagactatggatttggcatgtttacgaccaacatatggatgaaattccgagaaggaagttcggaagtgtgtgaccatagattaatgtcggcggcaattaaagatcagaaagctgtgcatgctgacatgggttattggatagagagctcaaaaaaccagacctggcaaatagagaaagcatcccttattgaagtgaaaacatgcctgtggcccaaaacccacacgttgtggagcaatggagtgctggaaagtcagatgctcattccaagatcatatgcaggccctttttcacagcacaattaccgccagggctatgccacgcaaaccgcgggcccatggcacttgggcaaattggagatagactttggagaatgtcccggaacaacagtcacaattcaggaggattgtgaccatagaggcccatctttgaggaccaccacagcatctggaaaactggtcacgcagtggtgctgccgctcctgcacgatgccccccttaaggttcttgggagaagatggatgctggtacgggatggagattaggcccttgagtgaaaaagaagagaacatggtcaaatcacaggtaacagccggacagggtacatcagaaactttttctatggggctgctatgcctgaccctgttcgtggaagaatgcttaaggagaagagtcactaggaaacacatgatattggttgtggtaatcaccttctgtgctatcatcctaggaggtctcacatggatggacttactacgagcccttatcatgttaggggacaccatgtctggtagaataggaggacagattcacctagccatcatggcagtgttcaagatgtcaccaggatatgtgctgggtgtgtttttaaggaaacttacttcaagagagacagcgctaatggtaataggaatggccatgacaacggtgttttcaattccacatgagctcatggaactcattgatggaatatcattggggttgatattactaaaaatagtaacacactttgataacacccaagtgggaactttagccctttccctgactttcataagatcaacaacaccattagtcatggcttggaggaccatcatggctgtgttctttgtggtcacactcattcctttgtgcaggacaagctgtcttcaaaaacagtcccattgggtagaaataacagcacttatcttaggagcccaggctttgccagtgtacctaatgactctcatgaaaggagcctcaagaagatcttggcctcttaatgagggcataatggctgtgggtttggtgagcctcttaggaagcgccctcctaaagaatgatgttcctttagctggcccaatggtggcaggaggcttacttctagcggcttacgtaatgagtggtagctcagcagacctgtcactagagaaggctgccaatgtgcaatgggatgaaatggcggacataactggctcaagcccgatcatagaagtgaagcaggatgaagatggctctttctccatacgggacgtcgaggaaaccaacatgataaccctcttggtgaaactggcgctgataacagtatcaggtctttaccccttggcaattccagttacaatggcactatggtatgtttggcaagtgaaaactcaaagatcaggagctctgtgggacgtcccctcacccgctgccactcagaaagccacactgtctgaaggggtgtataggatcatgcaaagagggttgttcgggaaaactcaggttggagtggggatacacatggaaggtgtgttccacacaatgtggcacgtaacaagaggatcagtgatctgccatgagacagggagattagagccatcttgggctgacgtcaggaatgacatgatatcatacggtgggggatggaggctcggagacaagtgggacaaagaagaagatgttcaggtcctagccatagaaccaggaaaaaatcctaaacatgtccaaacgaaaccaggccttttcaagaccctaactggagaaattggagcagtaactctggatttcaaacccggaacgtctggctctcctatcataaacaagaaagggaaagttattggactctatggaaatggagtagttaccaaatcaggtgattacgtcagtgccataacgcaagccgaaagaattggtgagccagattatgaagtggatgaggacatcttccgaaagaaaagattaaccataatggacttacaccccggagccggaaaaacaaaaagaattctcccatcaatagtcagagaagctttgaaaaggaggctgcgaaccttgattctggcccccacgagagtggtggcggccgagatggaagaggccttacgcggactgccaatccgttatcagaccccagctgtgaaatcagagcacacaggaagagagattgtagacctcatgtgtcatgcaaccttcacaacgagacttttgtcatcaaccagggttccaaattataacctcatagtgatggatgaagcacattttactgacccttgtagtgtcgcagctagaggatacatctcaaccagggtggaaatgggagaggcagcagctatcttcatgactgcaacccctcctggatcgatagatcccttcccccagagcaacagcccaatagaagacatcgagagggaaatcccagaaaggtcatggaacacagggttcgactggataacagactaccaagggaaaactgtgtggtttgttcccagcataaaagctggaaatgacattgcaaattgtttgagaaagtcgggaaagagagtgatccagttgagcagaaaaacctttgacacagagtatccaaagacgaaactcacggactgggattttgtggtcaccacagacatatctgaaatgggagccaatttcagagctgggagagtgatagaccccaggagatgcctcaagccagttatcctgacagatgggccagagagagttattctagcaggtccaattccagtaactccagcaagtgccgctcagaggagagggcgaataggtaggaatccagcacaagaagatgaccaatatgttttctccggagacccactaaagaatgatgaagatcatgctcactggacagaagcaaagatgttgcttgacaatatctacactcctgaagggataattccaacattgtttggtccggaaagggaaaaaacccaagctattgatggagagtttcgcctcagaggggaacaaaggaagacttttgtggaattgatgaggagaggagaccttccggtgtggctgagctataaggtagcttctgccggtatatcttacaaagaccgagaatggtgcttcacaggggaaaggaataaccaaattttagaagaaaacatggaggttgaaatctggactagagagggagaaaagaaaaagctaaggccaaaatggttagatgcacgtgtgtacgctgaccccatggctttgaaggatttcaaggagtttgccagtggaagaaagagcataactcttgacatcctaacagagattgccactttgccaacttacctttcctctaaggccaagctagcccttgacaacatagtcatgcttcacacaacagaaaaaggagggagggcctaccaacatgccctgaacgaactcccggagtcactggaaacactcatgcttgtagccctactaggtgctatgacagccggtatcttcctgtttttcatgcaggggaaaggaatagggaaattgtcaatgggtctgatagccatagctgtggctagtggcttgctctgggtagcagaaattcagccccagtggatagcagcttcaatcatactggagttttttcttatggtgctgttgataccagaaccagaaaaacaaaggaccccacaagacaatcaattgatctacgttatattgaccattctcaccatcattggtcttatagcagccaatgagatggggctgattgaaaaaacaaaaacggactttgggttctaccaggtaaaaacagaaaccaccattcttgatgtggatttgagaccagcctcagcgtggacactctatgcagtggccaccactattctgactcccatgctgaggcacaccatagagaacacgtctgccaacctatctctagcagccattgccaaccaagcagctgtcctaatgggacttggaaaaggatggccgctccacaggatggacctcggtgtgccgctgctagcaatgggatgttattctcaagtgaacccaacaaccttgacagcatccctagttatgcttttagttcattatgccataataggtccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaagtcatgctactagtcctgtgtgttggacaattacttttgatgagaacaacatgggctctctgcgaagtgctgactctggccacaggaccagtcatgaccttgtgggagggcaacccgggaaggttttggaacacaaccatagctgtatctacagctaacatttttagaggaagctacctggcgggagctggactagctttttcgctcataaagaatgcacaaacccctaggaggggaactgggaccacaggagagacactgggagagaagtggaagagacagctaaactcattagacagaaaagagtttgaagagtacaaaagaagtggaatactagaagtggataggactgaagccaagtctgccctaagagatggatccaaaatcaagtatgcggtgtccagagggtctagtaagatcagatggattgttgaaagaggaatgataaaaccaaaaggaaaggtcgtagatcttggttgcgggaggggaggatggtcctattacatggcgacactcaagaacgtgactgaagtgaaaggatatactaaaggaggtccaggacatgaagaaccaatccccatggctacttatggctggaatttggtcaaactccattcaggagttgatgtgttctacaaacccacagagcaggtggacaccctgctttgtgacattggggagtcatcctctaatccgacaatagaggaaggaagaacattgagagtcttgaagatggtggagccatggctctcttcaaaacctgagttctgcatcaaagtcctcaatccctacatgccgacagttatagaggagctggagaaactgcagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacaatcattgggagaaggcttcagagattgcgagaagagcacaaagaaacctggcactatgaccaggaaaacccatacagaacctgggcgtatcatggaagctatgaagccccttcgacaggctcagcatcctccatggtgaacggggtagtaaaactgctgacaaaaccttgggatgtgattccaatggtgactcagttggccatgacagacacaaccccttttgggcaacaaagagtattcaaggagaaggtggataccagaacaccacaaccaaaacccggcacacggatgattatgaccacgacagccaattggttgtgggccctcctcgggaagaagaaaagtcctagactgtgcacaagggaagagttcatctcaaaagttaggtcaaatgcagccataggcgcagtctttcaggaagaacagggatggacatcagccagtgaggctgtgaatgacagccggttctgggaactggttgacaaagaaagggctctgcaccaggaaggaaaatgtgaatcgtgtgtctacaacatgatgggaaagcgtgagaaaaaattaggagagtttggtagggccaagggaagccgagcaatctggtacatgtggctgggggcgcggttcctggaatttgaagccctgggttttttgaatgaagatcactggtttagcagagaaaactcatggagtggagtggaaggggaaggtctacatagattgggatacatcttggaggacatagacaagaaggatggagacctgatatatgctgacgacacagcaggctgggacacgagaatcactgaagatgaccttttaaatgaagaactgatcacagaacagatggcccctcaccacaagaccctagccaaagccattttcaaactaacctatcaaaacaaagtggtgaaagttctcagacccacaccgaaaggagcggtaatggacattatatccaggaaagatcaaagaggtagtggacaggttggaacatatggtttaaacacattcactaacatggaagtccaactcatccgccaaatggaagctgaaggagtcatcacacaagacgacatgcagaacccaaaagggttgaaagaaagagtcgagaaatggctgaaagagtgtggcgtcgacaggttgaagaggatggcaatcagtggagatgattgcgtggtgaagcccttagatgagaggtttagcacctccctcctcttcttgaatgatatgggaaaggtgaggaaagatatcccgcagtgggaaccatccaagggatggaaaaactggcaagaggttcctttttgctcccaccatttccacaagatcttcatgaaagatggccgctcactggttgttccatgcagaaaccaggatgaactgataggaagagccagaatttcgcagggggctggatggagcttgagagaaacagcctgtctgggcaaagcttacgcccagatgtggtcgcttatgtatttccatagaagggacctgcgcctagcctccatggccatatgctcagcagttccaacagaatggtttccaacaagcagaacaacatggtcaatccacgctcatcaccagtggatgaccactgaagatatgcttaaagtgtggaacagagtgtggatagaagataaccctaatatgactgacaagactccagtccattcgtgggaagacataccttacctagggaaaagagaggatctgtggtgcggatccctgattggactttcttccagagccacctgggcgaagaacattcacacggccataacccaggtcaggaatctgatcggaaaagaggaatacgtggattacatgccagccatgaaaagatacagcgctcctttcgagagtgaaggagttctgtaa

SEQ ID NO: 7859 - RNA, 9867 nt, synthetic construct
  misc_feature 1..9867: note = derived and/or modified CDS sequence (wt) from DENV-4__JQ915085__SS-prME
  source 1..9867: mol_type = other RNA
tcaacaatgacattgctgtgtttaattcctaccgtaatggcgtttcacctgtcaacaagagacggcgaacccctcatgatagtggcaaaacacgaaagggggagacctctcttgtttaagacaacagaaggaatcaacaaatgcaccctcattgccatggacctgggtgaaatgtgtgaagacactgtcacttacaaatgtcctctactggttaacaccgaacctgaagacattgattgctggtgcaatctcacgtccacctgggtcatgtacgggacatgcacccagagcggagaacggaggcgagagaagcgctcagtagctttaacaccacattcaggaatgggattggaaacaagagctgagacatggatgtcatcggaaggggcttggaaacatgctcagagagtggaaagctggatactcagaaacccaggattcgcgctcctggcaggatttatggcttacatgattgggcaaacaggaatccagcgaactgttttctttgtcctaatgatgctagtcgccccatcctacggaatgcgatgcgtaggggtagggaacagagacttcgtggaaggagtctcgggtggagcatgggtcgacttggtgctagaacatggaggatgcgtcacaaccatggcccagggaaaaccaaccctggattttgaactgaccaagacaacagctaaggaagtggctctgttgagaacctattgtattgaagcttcgatatcaaacataaccacagcaacaagatgtccaacgcaaggagagccttatctcaaagaggaacaagaccaacagtacatttgccggagagacgtggtagacagagggtggggcaatggctgtggcttgtttggaaaaggaggagttgtgacatgtgcgaagtttttatgctcggggaagataacaggcaatctggtccaaattgaaaaccttgaatacacggtagttgtgacagtccacaatggagacacccatgcagtaggaaatgacacatccaatcatggagtgacagccacgataactcccaggtcaccatcggtagaagttaaattgccggactatggagaactaacacttgactgtgaacccaggtctggaattgatttcaatgagatgatcctgatgaaaatgaaaaagaaaacgtggcttgtgcacaagcaatggtttttggacctacctctaccttggacagcaggagcagacacatcagaagttcattggaattacaaagagagaatggtgacattcaaggttcctcatgccaagagacaggatgtgacagtgctaggatctcaggagggagctatgcattctgccctcgccggagccacagaagtggattctggtgatggaaatcacatgtttgcaggacatctcaagtgcaaagtccgtatggagaaattgagaattaagggaatgtcatacacgatgtgttcaggaaagttctcaatagacaaagagatggcagaaacacagcatgggacaacagtggtgaaagtcaagtacgaaggcgctggagctccgtgtaaagtccccatagagataagagatgtgaacaaggaaaaagtagttgggcgcatcatctcatctactccctttgctgagaataccaacagcgtaaccaacatagaattagaacccccttttggggacagctacatagtgataggtgttggagatagtgcattaacactccattggttcaggaaagggagctccattggcaagatgtttgagtccacatacagaggtgcaaaacgaatggccattttaggtgaaacagcttgggattttggttctgttggtggactgttcacatcactgggaaaggctgtacaccaagtttttggaagtgtgtatacaaccatgtttggaggggtctcatggataattagaatcctaattgggttcttagtactgtggattggcacgaattcaagaaatacttcaatggcaatgacgtgcatagctgttggaggaatcactctgtttctaggtttcacagttcaagcagacatgggttgtgtggtgtcatggaatgggaaggaactaaaatgtggaagcggaatctttgtggttgacaacgtgcacacttggacagaacagtacaaattccaaccagagtccccagcgaggctagcgtctgcaatattgaatgcccacaaagatggggtctgtggaatcagatcaaccacgaggctggaaaatgttatgtggaagcaaataaccaacgagctaaactatgttctctgggaaggaggacatgacctcactgtagtggctggggacgtgaaaggggtgttgactaaaggcaagagagcactcacacctccagtgaatgatctgaaatattcatggaagacatggggaaaagcaaaaatctttaccccagaagcaagaaatagcacatttttaatagacggaccagacacctccgaatgccccaatgaacgaagagcatggaacttttttgaggtagaagactatggatttggcatgtttacgaccaacatatggatgaaattccgagaaggaagttcagaagtgtgtgaccatagattaatgtcggcggcaatcaaagatcagaaagctgtgcatgctgacatgggttattggatagagagctcaaaaaaccagacctggcagatagagaaagcatcccttattgaagtgaaaacatgtctgtggcccaaaactcacacgctatggagcaatggagtgctggaaagtcagatgctcattccaagatcatatgcaggccctttttcacagcacaattaccgccagggctatgccacgcaaaccgcgggcccatggcacttgggcaaattggagatagactttggagaatgtcccggaacaacagtcacaattcaggaggattgtgaccatagaggcccatctttgaggaccaccactgcatctggaaaactggtcacgcagtggtgctgccgctcctgcacgatgcctcccttaaggttcttgggagaagatggatgctggtacgggatggagattaggcccttgagtgaaaaagaagagaacatggtcaaatcacaggtaacagccggacagggtacatcagaaactttttctatggggctgctatgcctgaccttgttcgtggaagaatgcttaaggagaagagtcactaggaaacacatgatattggttgtggtaatcaccttctgtgctatcatcctaggaggtctcacatgggtggacttactacgagcccttatcatgttaggggacactatgtctggtagaataggaggacagattcacctagccatcatggcagtgttcaagatgtcaccaggatatgtgctgggtgtgtttttaaggaaacttacttcaagagagacagcgctgatggtaataggaatggccatgacaacggtgttttcaattccacgtgacctcatggaactcattgatggaatatcattggggttgatattactaaaaatagtaacacactttgacaacacccaagtgggaaccttagccctttccctgactttcataagatcaacaacaccattagtcatggcttggaggaccatcatggttgtgttctttgtggtcacactcattcctttgtgcaggacaagctgtcttcaaaaacagtcccattgggtagaaataacagcacttatcttaggagcccaggctttgccagtgtacctaatgactctcatgaaaggagcctcaagaagatcttggcctcttaatgagggcataatggctgtgggtttggtgagcctcttaggaagcgccctcctaaagaatgatgttcctttagctggcccaatggtggcaggaggcttacttctagcggcttacgtaatgagtggtagctcagcagacctgtcactagagaaggctgccaatgtgcaatgggatgaaatggcggacataactggctcaagcccaatcatagaagtgaagcaggatgaagatggctctttctccatacgagacgtcgaggaaaccaacatgataaccctcttggtgaaactggcgctgataacagtatcaggtctttaccccttggcaattccagttacaatggcactatggtatatttggcaagtgaaaacacaaagatcaggagctctgtgggacgtcccctcacccgctgccattcagaaagccacactgtctgaaggggtgtataggatcatgcaaagagggttgttcgggaaaactcaggttggagtagggatacacatggaaggtgtattccacacaatgtggcacgtaacaagaggatcagtgatctgccatgagacagggagattagagccatcttgggctgacgttaggaatgacatgatatcatacggtgggggatggaggctcggagacaaatgggacaaagaagaagatgttcaggtcctagccatagaaccaggaaaaaatccaaaacatgttcaaacgaaaccaggccttttcaagaccctaactggagaaattggagcagtaactctggatttcaaacccggaacgtctggctctcctatcataaacaagaaagggaaagttattggactctatggaaatggagtagttaccaaatcaggtgattacgtcagtgccataacgcaagccgaaagaattggtgagccagattatgaagtggatgaggacatttttcgaaagaaaaggttaactataatggacttacaccccggagccggaaagacaaaaagaattctcccatcaatagtcagagaagctttgaaaaggaggctgcgaaccttgattttggcccccacaagagtggtggcggccgagatggaagaggccttacgcggactgccaatccgttatcagaccccagctgtgaaatcagagcacacaggaagagagattgtagaccttatgtgtcatgcaaccttcacaacgagacttttgtcatcaaccagggttccaaattataacctcatagtgatggatgaagcacattttactgacccttgtagtgtcgcagctagaggatacatttcaaccagggtggaaatgggagaggcagcagctatcttcatgactgcaacccctcctggatcgatagatcccttcccccagagcaacagcccaatagaagacatcgagagggaaatcccagaaaggtcatggaacacagggttcgactggataacagactaccaagggaaaactgtgtggtttgttcccagcataaaagctggaaatgacattgcaaattgtttgagaaagtcgggaaagaaagtaatccagttgagcagaaaaacctttgacacagagtatccaaagacgaaactcacggactgggattttgtggtcaccacagacatatctgaaatgggagccaatttcagagctgggagagtgatagaccccaggagatgcctcaagccagttatcctaacagatgggccagagagagttattctagcaggtccaattccagtaactccagcaagtgccgctcagagaagagggcgaataggtaggaatccagcacaagaagatgaccaatatgttttctccggagacccactaaagaatgatgaagatcatgctcactggacagaagcaaagatgctgcttgacaatatctacactcctgaagggataattccaacattgtttggtccggaaagggaaaaaactcaagccattgatggagagtttcgcctcagaggggaacaaaggaagacttttgtggaattgatgaggagaggagaccttccggtgtggctgagctacaaggtagcttctgccggtatatcttataaagaccgagaatggtgcttcacaggggaaaggaataaccaaattttagaagaaaacatggaggttgaaatctggactagagagggagaaaagaaaaagttaaggccaaaatggttagatgcacgtgtgtacgctgaccccatggctttgaaggatttcaaggagtttgccagtggaagaaagagcataactcttgacatcctaacagagattgccactttgccaacttacctttcctctaaggccaagctagcccttgacaacatagtcatgctccacacagcagaaaaaggagggagggcctaccaacacgccctgaacgaactcccggagtcactggaaacactcatgcttgtagccctactaggtgctatgacagccggtatcttcctgtttttcatgcaggggaaaggaatagggaaattgtcaatgggtctgatagccatagctgtggctagcggcttgctctgggtagcagaaattcagccccagtggatagcagcttcaatcatactggagttttttcttatggtgctgttgataccagaaccagaaaaacaaaggaccccacaagacaatcaattgatctacgttatattgaccattctcaccattattggtcttatagcagccaatgagatggggctgattgaaaaaacaaaaacggactttgggttctaccaggtaaaaacagaaaccaccattctggatgtagatttgagaccagcctcagcgtggacactctatgcagtggccaccactattctgactcccatgctgagacacaccatagagaacacgtctgccaacctatctctagcagccattgccaaccaagcagctgtcctaatgggacttggaaaaggatggccgctccacagaatggacctcggtgtgccgctgctagcaatgggatgttattctcaagtgaacccaacaaccttgacagcatccctagtcatgcttttagttcattatgccataataggtccaggattgcaggcaaaagccacaagagaggcccagaaaaggacagctgctgggatcatgaaaaaccccactgtggacgggataacagtaatagatctagaaccaatatcctatgacccaaaatttgaaaagcaattagggcaagtcatgctactagttctgtgtgttggacaattacttttgatgagaacaacatgggctctctgcgaagtattgactctggccacaggaccaatcatgaccttgtgggagggcaacccaggaaggttttggaacacaaccatagctgtatccacagccaacatttttagaggaagctacttggcgggagctggactagctttttcgctcataaagaatgcacaaactcctaggaggggaactgggactacaggagagacactgggagagaagtggaagagacagctaaactcattagatagaaaagagtttgaagagtacaaaagaagtggaatactagaagtggataggactgaggccaagtctgccctaagagatggatctaaaatcaagcatgcggtgtccagagggtctagtaagatcagatggattgttgaaagaggaatgataaaaccaaaaggaaaggtcgtagatcttggttgcgggaggggaggatggtcctattacatggcgacactcaagaacgtgactgaagtgaaaggatataccaaaggaggtccaggacatgaagaaccaatccccatggccacttatggttggaatttggtcaaactccattcaggggttgatgtgttctacaaacccactgagcaggtggataccctgctctgtgacattggggagtcatcctctaatccgacaatagaggaaggaagaacattgagagtcttgaagatggtggagccatggctctcttcaaaacctgagttctgcatcaaagtcctcaacccctacatgccgacagttatagaagagctggagaaactgcagagaagacatggtggaagcctcgtcagatgcccgttatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacaatcattgggagaaggcttcagagattgcgagaagagcacaaagaaacctggcactatgaccaggaaaacccatacagaacctgggcgtatcatggaagctatgaagctccttcgacaggctcagcatcctccatggtgaacggggtagtaaaactgctgacaaaaccttgggatgtgattccaatggtgactcagttggccatgacagacacaaccccttttgggcaacaaagagtgttcaaggagaaggtggataccagaacaccacaaccaaaacccggcacacgaatgattatgaccacgacagccaattggttgtgggccctcctcgggaagaagaaaagtcccagactgtgcacaagggaagagttcatctcaaaagttaggtcaaatgcagccataggcgcagtctttcaggaagaacagggatggacatcagccagtgaagccgtgaatgacagccggttctgggaactggttgacaaagaaagggctctgcaccaggaaggaaaatgtgaatcgtgtgtctacaacatgatggggaaacgtgagaaaaaattaggagagtttggtagggccaagggaagccgagcgatctggtacatgtggctgggggcgcggttcctggaatttgaagccctgggtttcttgaatgaagatcactggttcagcagagaaaactcatggagtggagtggaaggggaaggtctacacagattgggatacatcttggaggacatagataagaaggatggagacctgatatatgctgacgacacagcaggctgggacacgagaatcactgaagatgaccttttaaatgaagaactgatcacagaacagatggcccctcaccacaagaccctagccaaagccattttcaaactaacctatcaaaacaaagtggtgaaagttctcagacccacaccaaaaggagcggtaatggacatcatatccaggaaagaccaaagaggtagtggacaggttggaacatatggtttaaacacattcactaacatggaagttcaactcatccgccaaatggaagctgaaggagtcatcacacaagacgacatgcagaacccaaaagggttgaaagaaagagttgagaaatggctgaaagagtgtggcgtcgacaggttgaagaggatggcaatcagtggagatgattgcgtggtgaagcccctggatgagaggtttagcacctccctcctcttcttgaatgacatgggaaaggtgagaaaagacatcccgcagtgggaaccatccaagggatggaaaaactggcaagaggttcctttttgctcccaccatttccacaagatcttcatgaaagatggccgctcactggttgttccatgcagaaaccaggatgaactgataggaagagccagaatctcgcagggggctggatggagcttgagagaaacagcctgtctgggcaaagcttacgcccagatgtggtcgcttatgtatttccatagaagggacctgcgcctagcctccatggccatatgctcagcagttccaacagaatggtttccaacaagcagaacaacatggtcaatccacgctcatcaccagtggatgaccactgaagatatgcttaaagtgtggaacagagtgtggatagaagataaccccaatatgactgacaagactccagtccattcgtgggaagacataccttacctagggaaaagagaggatctgtggtgtggatccctgattggactttcttccagagccacctgggcgaagaacattcacacggccataacccaggtcaggaatctgatcggaaaagaggaatacgtggattacatgccagccatgaaaagatacagcgctcctttcgagagtgaaggagttctgtaa

SEQ ID NO: 7860 - RNA, 9867 nt, synthetic construct
  misc_feature 1..9867: note = derived and/or modified CDS sequence (wt) from DENV-4__JQ915088__SS-prME
  source 1..9867: mol_type = other RNA
tcaacaatgacattgctgtgtttgattcccaccgtaatggcatttcacctgtcaacaagagacggcgaacccctcatgatagtggcaaaacacgaaagggggagacctctcttgttcaagacaacagaaggaatcaacaaatgcaccctcattgccatggacctgggtgaaatgtgtgaagacactgtcacgtataaatgccctctactggttaacaccgaacctgaagacatcgattgctggtgcaatctcacgtccacctgggtcatgtacgggacgtgcacccagagcggagaacggaggcgagagaagcgctcagtagctttaacaccacattcaggaatgggattggaaacaagagctgagacatggatgtcatcggaaggggcttggaaacatgctcagagagtggaaagctggatactcagaaacccaggattcgcgctcctggcaggatttatggcttacatgattgggcaaacaggaatccagcgaattgttttctttgtcctaatgatgctagtcgccccatcctacggaatgcgatgcgtaggggtagggaacagagacttcgtggaaggagtctcgggtggagcatgggtcgacttggtgctagaacatggaggatgcgtcacaaccatggcccagggaaaaccaaccctggattttgaactgaccaagacaacagctaaggaagtggctctgttgagaacctattgtattgaagcttcgatatcaaacataaccacagcaacaagatgtccaacgcaaggagagccttatctcaaagaggaacaagaccaacagtacatttgccggagagacgtggtagacagagggtggggcaatggctgtggcttgtttggaaaaggaggagttgtgacatgtgcgaagtttttatgctcggggaagattacaggcaatctggtccaaattgaaaaccttgaatacacggtagttgtgacagtccacaatggagacacccatgcagtaggaaatgacacatccaatcatggagtgacagccacgataactcccaggtcaccatcggtagaagttaaattgccggactatggagaactaacactcgactgtgaacccaggtctggaattgatttcaatgagatgatcctgatgaaaatgaaaaagaaaacgtggcttgtgcacaagcaatggtttttggacctacctctaccttggacagcaggagcagacacatcagaagttcattggaattacaaagagagaatggtgacattcaaggttcctcatgccaagagacaggatgtgacagtgctaggatctcaggagggagctatgcactctgccctcgccggagcaacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtatgaaggcgctggagctccgtgtaaaatccccatagagataagagatgtgaacaaggagaaagtagttgggcgcatcatctcatctaccccttttgctgagaataccaacagcgtaatcaacatagaattagaacccccttttggggacagctacatagtgataggtgttggagatagtgcattaacactccattggttcagaaaagggagctctattggcaagatgtttgagtccacatacagaggtgcaaaacgaatggccattctaggtgaaacagcttgggattttggttctgttggtggactgtttacatcactgggaaaggctgtacaccaagtttttggaagtgtgtatacaaccatgtttggaggggtctcatggatgattagaatcctaattgggttcttggtattgtggattggcacgaattcaagaaatacttcaatggcaatgacgtgcatagctgttggaggaatcactctgtttctaggtttcacagttcaagcagacatgggttgtgtggtgtcatggaatgggaaggaactaaaatgtggaagcggaatttttgtggttgacaacgtgcacacttggacagaacagtacaaattccaaccagagtccccagcgaggctagcgtctgcaatactgaatgcccacaaagatggggtctgtggaatcagatcaaccacgaggctggaaaatgttatgtggaagcaaataaccaacgagctaaactatgttctctgggaaggaggacatgacctcactgtagtggctggggacgtaaagggggtgttgaccaaaggcaagagagcactcacacctccagtgaatgatctgaaatattcatggaagacgtggggaaaagcaaaaatctctaccccagaagcaagaaatagcacatttttaatagacggaccagacacctccgaatgccccaatgaacgaagagcatggaacttttttgaggtagaagactatggatttggcatgttcacgaccaacatatggatgaaattccgagaaggaagttcagaagtgtgtgaccatagattaatgtcggcggcaatcaaagatcagaaagcagtgcatgccgacatgggttattggatagagagctcaaaaaaccagacctggcagatagagaaagcatccctcattgaagtgaaaacatgtctgtggcccaaaacccacacactgtggagcaatggggtgctggaaagtcagatgctcattccaagatcatatgcaggccctttttcacagcacaattaccgccagggctatgccacgcaaaccgcgggcccatggcacttaggcaaattggagatagactttggagaatgccccggaacaacagttaaaattcaggaagattgtgaccatagaggcccatctttgaggaccaccactgcatctggaaaactggttacgcaatggtgctgccgctcctgcacgatgcctcccttaaggttcttgggggaagacggatgttggtatgggatggagattaggcccttgagtgaaaaagaagagaacatggtcaaatcacaggtaacagccggacagggtacatcagaaactttttctatggggctgctatgcctgaccttgttcgtggaagaatgcttgaggagaagagtcactaggaaacacatgatattggttgtggtaatcaccttctgtgctatcatcttaggaggtctcacatggatggacttactgcgagcccttatcatgttaggggacactatgtctggtagaataggaggacagattcacctagccatcatgacagtgttcaagatgtcaccaggatatgtgctgggtgtgtttttaaggaaacttacttcaagagagacagcgctaatggtaataggaatggccatgacaacggtgttttcaattccacatgacctcatggaactcattgatggaatatcattggggctgatattactaaaaatagtaacacactttgataacacccaagtgggaaccttagccctttccctgactttcatgagatcaacaacaccattagtcatggcttggaggaccatcatggctgtgttctttgtgatcacacttattcctttgtgcaggacaagctgtcttcaaaaacagtcccattgggtagaaataacagcacttatcttaggagcccaggctttgccagtgtacctaatgactctcatgaaaggagcctcaagaagatcttggcctcttaatgagggtataatggctgtgggtttggtgagcctcttaggaagcgccctcctaaagaatgatgttcctttagctggcccaatggtagcaggaggcttacttctagcggcttacgtaatgagtggcagctcagcagacctgtcactagagaaggctgccaatgtacagtgggatgaaatggcggacataactggctcaagcccaatcatagaagtgaagcaggatgaagatggctctttctccatacgggacgtcgaggaaaccaacatgataaccctcttggtgaaactggcgctgataacagtatcaggtctttaccccttggcaattccagtcacaatggcactatggtatatttggcaagtgaaaacacaaagatcaggagctctgtgggacgtcccctcgcccgctgccactcagaaagccacactgtctgaaggggtgtataggatcatgcaaagagggctgtttgggaaaactcaggttggagtagggatacacatggaaggtgtattccacacaatgtggcacgtgacaagaggatcagtgatctgccatgagacagggagattagagccatcttgggctgacgtcaggaatgacatgatatcatacggtgggggatggaggctcggagacaaatgggataaagaagaagatgttcaggtcctggccatagaaccaggaaaaaatcctagacatgtccaaacgaaaccaggccttttcaagaccctaactggagaaattggagcagtaactctggatttcaaacctggaacgtctggctctcctatcatcaacaagaaagggaaagttattggactctatggaaatggagtagttaccaaatcaggtgattacgtcagtgccataacgcaagccgaaagaattggtgagccagattatgaagtagatgaggacatttttcgaaagaaaagattaactataatggacttacaccccggagctggaaagacaaaaagaattctcccatcaatagtcagagaagctttgaaaaggaggctgcgaaccttgattttggctcccacgagagtggtggcggccgagatggaagaggccctacgcggactgccaatccgctatcagaccccagctgtgaaatcagagcacacaggaagagagattgtagacctcatgtgccatgcaaccttcacaacgagacttttgtcatcaaccagggttccaaattacaaccttatagtgatggatgaagcacattttactgacccttgtagtgtcgcggctagaggatacatctcaaccagggtggaaatgggagaggcagcagctatcttcatgactgcaacccctcctggatcgatagatcccttcccccagagcaacagcccaatagaagacatcgagagggaaatccccgaaaggtcatggaacacagggttcgactggataacagactaccaaggaaaaactgtgtggtttgttcccagcataaaagccggaaatgacatcgcaaattgtttgagaaagtcgggaaagagagtgatccagttgagcagaaaaacctttgacacagagtatccaaagacgaaactcacggactgggattttgtggtcaccacagacatatctgaaatgggggccaattttagagctgggagagtgatagaccccaggagatgcctcaagccagttatcctaacagatgggccagagagagttattctagcaggtccaatcccagtaactccagcaagtgccgctcagagaagagggcgaataggtaggaatccagcacaagaagatgaccaatatgttttctccggagacccactaaagaatgatgaagatcatgctcactggacagaagcaaagatgttgcttgacaatatctacacccctgaagggataattccaacattgtttggtccggaaagggaaaaaacccaagccattgatggagagtttcgcctcagaggggaacaaaggaagactttcgtggaattgatgaggagaggagaccttccggtgtggctgagctacaaggtagcttctgccggtatctcttacaaagaccgagaatggtgcttcacaggagaaaggaataaccaaattttagaagaaaacatggaggttgaaatctggactagagagggagaaaagaaaaagctaaggccaaaatggttagatgcacgtgtgtacgctgaccccatggctttgaaggatttcaaggagttcgccagtggaagaaagagcacaactcttgacatcctaacagagatcgccactttgccaacctacctttcctctaaggccaaactagcccttgacaacatagtcatgctccacacaacagaaaaaggagggagggcctaccaacacgccctgaacgaactcccggagtcactggaaacactcatgctcgtagccctactaggtgctatgacagccggtatcttcctgttttttatgcaggggaaaggaatagggaaattgtcaatgggtctgatagctatggctgtggccagtggcttgctctgggtagcggaaattcagccccagtggatagcagcttcaatcatactggagttttttcttatggtgctgttgataccagaaccagaaaaacaaaggaccccacaagacaatcaattgatctacgttatattgactattctcaccattattggtctcatagcagccaatgagatggggctgattgaaaaaacaaaaacggactttgggttctaccaggtaaaaacagaaaccaccattcttgatgtggatttgagaccagcctcagcatggacactctatgcagtggccaccactattctgactcccatgctgagacacaccatagagaacacgtctgccaacttatctctagcagccattgccaaccaggcagctgtcctaatgggacttggaaaaggatggccgctccacagaatggacctcggtgtgccgctgttagccatgggatgttattcccaagtgaacccaacaaccctgacagcatccctagtcatgcttttaatccattatgccataataggtccaggattgcaggcaaaagccacaagagaggcccagaaaaggacagctgctgggatcatgaagaaccccacggtggacgggataacagtaatagatttagaaccaatatcctatgacccaaaatttgaaaagcagttagggcaagtcatgctactagtcctgtgtgttggacaattacttttgatgagaacaacctgggctctctgcgaagtattaactttggccacaggaccaatcatgaccttgtgggagggcaacccgggaaggttttggaacacgaccatagctgtatccacagccaacatttttagaggaagctacctggcgggggctggactagctttttcgctcataaagaatgcacaaacccctaggaggggaactgggaccacaggagagacactgggagagaagtggaagagacagctaaactcattagacagaaaagagtttgaagagtacaaaagaagtggaatattagaagtggataggactgaggccaagtctgccctaagagatggatctaaaatcaagcatgcggtgtccagagggtctagtaagatcagatggattgttgaaagagggatgataaagccaaaaggaaaggtcgtggatcttggttgcgggaggggaggatggtcctattacatggcgacactcaagaacgtgactgaagtgaaagggtatacaaaaggaggcccaggacatgaagaaccaattcctatggctacttatggctggaatttggtcaaactccattcaggggttgatgtgttctacaaacccactgagcaggtggacaccctgctctgtgacattggggagtcatcctccaatccaacaatagaggaaggaagaacattgagaatcttgaagatggtggagccatggctctcttcaaaacctgagttctgcatcaaagtcctcaacccctacatgccgacagttatagaagagttggagaaactgcagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacaatcattgggagaaggcttcagagattgcaagaagagcacaaagaaacctggcactatgaccaggaaaatccatacagaacctgggcgtatcatggaagctatgaagctccttcgacaggctcagcatcctccatggtgaacggggtagtgaaactgctgacaaaaccttgggatgtgattccaatggtgacccagttggccatgacagacacaaccccttttgggcaacaaagagtgttcaaggagaaggtggataccagaacaccacaaccaaaacttggcacacgaatgattatgaccacgacagccaattggttgtgggccctcctcgggaagaagaaaagtcccagactgtgcacaagggaagagttcatctcaaaagttaggtcaaatgcagccataggcgcagtctttcaagaagaacagggatggacatcagccagtgaagctgtgaatgacagtcggttctgggaactggttgacaaagaaagggctctgcaccaggaaggaaaatgtgaatcgtgtgtttataacatgatggggaaacgtgagaaaaaattaggagagtttggtagggccaagggaagccgagcaatctggtacatgtggctgggggcgcggttcctggaatttgaagccctgggttttttgaatgaagatcactggtttagcagagaaaactcatggagtggagtggaaggagaaggcctgcacagattgggatacatcttggaggacatagacaagaaggatggagacctgatatatgctgacgacacagcaggctgggacacgagaatcactgaggatgaccttttaaatgaagaactgatcacagaacagatggcccctcaccacaagaccctagccaaagccattttcaaactaacctatcaaaacaaagtggtgaaagtcctcagacccacaccgaaaggagcggtaatggacattatatccaggaaagaccaaagaggcagtggacaggttggaacatatggtttaaatacattcactaacatggaagttcaactcatccgccaaatggaagctgaaggagtcatcacacaagacgacatgcagaacccaaaagggttgaaagaaagagttgagaaatggctgaaagagtgtggcgtcgacaggttgaagaggatggcaatcagtggagatgattgcgtggtgaagcccctagatgagaggtttagcacctccctcctcttcttgaatgacatgggaaaggtgaggaaagacgtcccgcaatgggaaccatccaagggatggaaaaactggcaagaggttcccttttgctcccaccattttcacaagatcttcatgaaagatggccgctcactggttgttccatgcagaaaccaggatgaactgataggaagagccagaatctcgcagggggctggatggagcttgagagaaacagcctgtctgggcaaagcttacgcccagatgtggtcgcttatgtacttccatagaagggacctgcgcctagcctccatggccatatgctcagcagttccaactgaatggtttccaacaagcagaacaacatggtcaatccatgctcaacatcagtggatgaccactgaagatatgcttaaagtgtggaacagagtgtggatagaagacaaccccaatatgactgacaagactccagtccattcgtgggaagacataccttacctagggaaaagagaggatctgtggtgtggatccctgattggactttcttccagagccacctgggcgaagaacattcacacggccataacccaggtcaggaatctgatcggaaaagaggaatacgtggattacatgccagtcatgaaaagatacagctctccttccgagagtgaaggagttctgtaa

SEQ ID NO: 7861 - RNA, 9867 nt, synthetic construct
  misc_feature 1..9867: note = derived and/or modified CDS sequence (wt) from DENV-4__JQ915086__SS-prME
  source 1..9867: mol_type = other RNA
tcaacaatgacattgctgtgtttgattcccaccgtaatggcatttcacctgtcaacaagagacggcgaacccctcatgatagtggcaaaacacgaaagggggagacctctcttgttcaagacaacagaaggaatcaacaaatgcaccctcattgccatggacctgggtgaaatgtgtgaagacactgtcacgtataaatgccctctactggttaacaccgaacctgaagacattgattgctggtgcaatctcacgtccacctgggtcatgtacgggacgtgcacccagagcggagagcggaggcgagagaagcgctcagtagctttaacaccacattcaggaatgggattggaaacaagagctgagacatggatgtcatcggaaggggcttggaaacatgctcagagagtggaaagctggatactcagaaacccaggattcgcgctcctggcaggatttatggcttacatgattgggcaaacaggaatccagcgaactgttttctttgtcctaatgatgctagtcgccccatcctacggaatgcgatgcgtaggggtagggaacagagacttcgtggaaggagtctcgggtggagcatgggtcgacttggtgctagaacatggaggatgcgtcacaaccatggcccagggaaaaccaaccctggattttgaactgaccaagacaacagctaaggaagtggctctgttgagaacctattgtattgaagcttcgatatcaaacataaccacagcaacaagatgtccaacgcaaggagagccttatctcaaagaggaacaagaccaacagtacatttgccggagagacgtggtagacagagggtggggcaatggctgtggcttgtttggaaaaggaggagttgtgacatgtgcgaagtttttatgctcggggaagataacaggcaatctggtccaaattgaaaaccttgaatacacggtagttgtgacagtccacaatggagacacccatgcagtaggaaatgacacatccaatcatggagtgacagccacgataactcccaggtcaccatcggtagaagttaaattgccggactatggagaactaacacttgactgtgaacccaggtctggaattgatttcaatgagatgatcctgatgaaaatgaaaaagaaaacgtggcttgtgcacaagcaatggtttttggacctacctctaccttggacagcaggagcagacacatcagaagttcattggaattacaaagagagaatggtgacattcaaggttcctcatgccaaaagacaggatgtgacagtgctaggatctcaggagggagctatgcactctgccctcgccggagcaacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtatgaaggcgctggagctccgtgtaaaatccccatagagataagagatgtgaacaaggagaaagtagttgggcgcatcatctcatctaccccttttgctgagaataccaacagcgtaatcaacatagaattagaacccccttttggggacagctacatagtgataggtgttggagatagtgcattaacactccattggttcagaaaagggagctctattggcaagatgtttgagtccacatacagaggcgcaaaacgaatggccattctaggtgaaacagcttgggattttggttctgttggtggactgtttacatcactgggaaaggctgtacaccaagtttttggaagtgtgtatacaaccatgtttggaggggtctcatggatgattagaatcctaattgggttcttggtattgtggattggcacgaattcaagaaatacttcaatggcaatgacgtgcatagctgttggaggaatcactctgtttctaggtttcacagttcaagcagacatgggttgtgtggtgtcatggaatgggaaggaactaaaatgtggaagcggaatttttgtggttgacaacgtgcacacttggacagaacagtacaaattccaaccagagtccccagcgaggctagcgtctgcaatactgaatgcccacaaagatggggtctgtggaatcagatcaaccacgaggctggaaaatgttatgtggaagcaaataaccaacgagctaaactatgttctctgggaaggaggacatgacctcactgtagtggctggggacgtaaagggggtgttgaccaaaggcaagagagtactcacacctccagtgaatgatctgaaatattcatggaagacgtggggaaaagcaaaaatctttaccccagaagcaagaaatagcacatttttaatagacggaccagacacctccgaatgccccaatgaacgaagagcatggaacttttttgaggtagaagactatggatttggcatgtttacgaccaacatatggatgaaattccgagaaggaagttcagaagtgtgtgaccatagattaatgtcggcggcaatcaaagatcagaaagctgtgcatgccgacatgggttattggatagagagctcaaaaaaccagacctggcagatagagaaagcatccctcattgaagtgaaaacatgtctgtggcccaaaacccacacactgtggagcaatggggtgctggaaagtcagatgctcattccaagatcatatgcaggccctttttcacagcacaattaccgccagggctatgccacgcaaaccgcgggcccatggcacttaggcaaattggagatagactttggagaatgccccggaacaacagttaaaattcaggaagattgtgaccatagaggcccatctttgaggaccaccactgcatctggaaaactggttacgcaatggtgctgccgctcctgcacgatgcctcccttaaggttcttgggggaagacggatgttggtatgggatggagattaggcccttgagtgaaaaagaagagaacatggtcaaatcacaggtaacagccggacagggtacatcagaaactttttccatggggctgctatgcctgaccttgttcgtggaagaatgcttgaggagaagagtcactaggaaacacatgatattggttgtggtaatcaccttctgtgctatcatcttaggaggtctcacatggatggacttactgcgagcccttatcatgttaggggacactatgtctggtagaataggaggacagattcacctagccatcatgacagtgttcaagatgtcaccaggatatgtgctgggtgtgtttttaagaaaacttacttcaagagagacagcgctaatggtaataggaatggccatgacaacggtgttttcaattccacatgacctcatggaactcattgatggaatatcattggggctgatattactaaaaatagtaacacactttgataacacccaagtgggaaccttagccctttccctgactttcataagatcaacaacaccattagtcatggcttggaggaccatcatggctgtgttcttcgtgatcacacttattcctttgtgcaggacaagctgtcttcaaaaacagtcccattgggtagaaataacagcacttatcttaggagcccaggctttgccagtgtacctaatgactctcatgaaaggagcctcaagaagatcttggcctcttaatgagggtataatggctgtgggtttggtgagcctcttaggaagcgccctcctaaagaatgatgttcctttagctggcccaatggtggcaggaggcttacttctagcggcttacgtaatgagtggcagctcagcagacctgtcactagagaaggctgccaatgtacagtgggatgaaatggcggacataactggctcaagcccaatcatagaagtgaagcaggatgaagatggctctttctccatacgggacgtcgaggaaaccaacatgataaccctcttggtgaaactggcgctgataacagtatcaggtctctaccccttggcaattccagtcacaatggcactatggtatatttggcaagtgaaaacacaaagatcaggagctctgtgggacgtcccctcgcccgctgccactcagaaagccacactgtctgaaggggtgtataggatcatgcaaagagggctgtttgggaaaactcaggttggagtagggatacacatggaaggtgtattccacacaatgtggcacgtgacaagaggatcagtgatctgccatgagacagggagattagagccatcttgggctgacgttaggaatgacatgatatcatacggtgggggatggaggctcggagacaaatgggataaagaagaagatgttcaggtcctagccatagaaccaggaaaaaatcctagacatgtccaaacgaaaccaggccttttcaagaccctaactggagaaattggagcagtaactctggatttcaaacctggaacgtctggctctcctatcatcaacaagaaagggaaagttattggactctatggaaatggagtagttaccaaatcaggtgattacgtcagtgccataacgcaagccgaaagaattggtgagccagattatgaagtagatgaggacattttccgaaagaaaagattaactataatggacttacaccccggagctggaaagacaaaaagaattctcccatcaatagtcagagaagctttgaaaaggaggctgcgaaccttgattttggctcccacgagagtggtggcggccgagatggaagaggccctacgcggactgccaatccgctatcagaccccagctgtgaaatcagagcacacaggaagagagattgtagacctcatgtgccatgcaaccttcacaacgagacttttgtcatcaaccagggttccaaattacaaccttatagtgatggatgaagcacattttactgacccttgtagtgtcgcggctagaggatacatctcaaccagggtggaaatgggagaggcagcagctatcttcatgactgcaacccctcctggatcgatagatcccttcccccagagcaacagcccaatagaagacatcgagagggaaatccccgaaaggtcatggaacacagggttcgactggataacagactaccaagggaaaactgtgtggtttgttcccagcataaaagccggaaatgacatcgcaaattgtttgagaaagtcgggaaagagagtgatccagttgagcagaaaaacctttgacacagagtatccaaagacgaagctcacggactgggattttgtggtcaccacagacatatctgaaatgggggccaattttagagctgggagagtgatagaccccaggagatgcctcaagccagttatcctaacagatgggccagagagagttattctagcaggtccaatcccagtaactccagcaagtgccgctcagagaagagggcgaataggtaggaatccagcacaagaagatgaccaatatgttttctccggagacccactaaagaatgatgaagatcatgctcactggacagaagcaaagatgttgcttgacaatatctacacccctgaagggataattccaacattgtttggtccggaaagggaaaaaacccaagccattgatggagagtttcgcctcagaggggaacaaaggaagactttcgtggaattgatgaggagaggagaccttccggtgtggctgagctacaaggtagcttctgccggtatctcttataaagaccgagaatggtgcttcacaggagaaaggaataaccaaattttagaagaaaacatggaggttgaaatctggactagagagggagaaaagaaaaagctaaggccaaaatggttagatgcacgtgtgtacgctgaccccatggctttgaaggatttcaaggagttcgccagtggaagaaagagcacaactcttgacatcctaacagagatcgccactttgccaacctacctttcctctaaggccaaactagcccttgacaacatagtcatgctccacacaacagaaaaaggagggagagcctaccaacacgccctgaacgaactcccggagtcactggaaacactcatgctcgtagccctactaggtgctatgacagccggtatcttcctgttttttatgcaggggaaaggaatagggaaattgtcaatgggtctgatagctatagctgtggccagtggcttgctctgggtagcggaaattcagccccagtggatagcagcttcaatcatactagagttttttcttatggtgctgttgataccagaaccagaaaaacaaaggaccccacaagacaatcaattgatctacgttatattgactattctcaccattattggtctcatagcagccaatgagatggggctgattgaaaaaacaaaaacggactttgggttctaccaggtaaaaacagaaaccaccattcttgatgtggatttgagaccagcctcagcatggacactctatgcagtggccaccactattctgactcccatgctgagacacaccatagagaacacgtctgccaacttatctctagcagccattgccaaccaggcagctgtcctaatgggacttggaaaaggatggccgctccacagaatggacctcggtgtgccgctgttagctatgggatgttattcccaagtgaacccaacaaccctgacagcatccctagtcatgcttttaatccattatgccataataggtccaggattgcaggcaaaagccacaagagaggcccagaaaaggacagctgctgggatcatgaagaaccccacggtggacgggataacagtaatagatttagagccaatatcctatgacccaaaatttgaaaagcagttagggcaagtcatgctactagtcctgtgtgttggacaattacttttgatgagaacaacctgggctctctgcgaagtattaactttggccacaggaccaatcatgaccttgtgggagggcaacccgggaaggttttggaacacgaccatagctgtatccacagccaacatttttagaggaagctacctggcgggagctggactagctttttcgctcataaagaatgcacaaacccctaggaggggaactgggaccacaggagagacactgggagagaagtggaagagacagctaaactcattagacagaaaagagtttgaagagtacaaaagaagtggaatattagaagtggataggactgaggccaagtctgccctaagagatggatctaaaatcaagcatgcggtgtccagagggtctagtaagatcagatggattgttgaaagagggatgataaagccaaaaggaaaggtcgtggatcttggttgcgggaggggaggatggtcctattacatggcgacactcaagaacgtgactgaagtgaaagggtatacaaaaggaggcccaggacatgaagaaccaattcccatggctacttatggctggaatttggtcaaactccattcaggggttgatgtgttctacaaacccactgagcaggtggacaccctgctctgtgacattggggagtcatcctccaatccaacaatagaggaaggaagaacattgagaatcttgaagatggtggagccatggctctcttcaaaacctgagttctgcatcaaagttctcaacccctacatgccgacagttatagaagagttggagaaactacagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacaatcattgggagaaggcttcagagattgcaagaagagcacaaagaaacctggcactatgaccaggaaaatccatacagaacctgggcgtatcatggaagctatgaagctccttcgacaggctcagcatcctccatggtgaacggggtagtaaaactgctgacaaaaccttgggatgtgattccaatggtgacccagttggccatgacagacacaaccccttttgggcaacaaagagtgttcaaggagaaggtggataccagaacaccacaaccaaaacttggcacacgaatgattatgaccacgacagccaattggttgtgggccctcctcgggaagaagaaaagtcccagactgtgcacaagggaagagttcatctcaaaagttaggtcaaatgcagccataggcgcagtctttcaagaagaacagggatggacatcagccagtgaagctgtgaatgacagccggttctgggaactggttgacaaagaaagggctctgcaccaggaaggaaaatgtgaatcgtgtgtctataacatgatggggaaacgtgagaaaaaattaggagagtttggtagggccaagggaagccgagcaatctggtacatgtggctgggggcgcggttcctggaatttgaagccctgggttttttgaatgaagatcactggtttagcagagaaaactcatggagtggagtggaaggagaaggcctgcacagattgggatacatcttggaggacatagacaagaaggatggagacctgatatatgctgacgacacagcaggctgggacacgagaatcactgaggatgaccttttaaatgaagaactgatcacagaacagatggcccctcaccacaagaccctagccaaagccattttcaaactaacctatcaaaacaaagtggtgaaagtcctcagacccacaccgaaaggagcggtaatggacattatatccaggaaagaccaaagaggcagtggacaggttggaacatatggtttaaatacattcactaacatggaagttcaactcatccgccaaatggaagctgaaggagtcatcacacaagacgacatgcagaacccaaaagggttgaaagaaagagttgagaaatggctgaaagagtgtggcgtcgacaggttgaagaggatggcaatcagtggagatgattgcgtggtgaagcccctagatgagaggtttagcacctccctcctcttcttgaatgacatgggaaaggtgaggaaagacgtcccgcaatgggaaccatccaagggatggaaaaactggcaagaggttcccttttgctcccaccattttcacaagatcttcatgaaagatggccgctcactggttgttccatgcagaaaccaggatgaactgataggaagagccagaatctcgcagggggctggatggagcttgagagaaacagcctgtctgggcaaagcttacgcccagatgtggtcgcttatgtacttccatagaagggacctgcgcctagcctccatggccatatgctcagcagttccaactgaatggtttccaacaagcagaacaacatggtcaatccatgctcaacaccagtggatgaccactgaagatatgcttaaagtgtggaacagagtgtggatagaagacaaccccaatatgactgacaagactccagtccattcgtgggaagacataccttacctagggaaaagagaggatctgtggtgtggatccctgattggactttcttccagagccacctgggcgaagaacattcacacggccataacccaggtcaggaatctgatcggaaaagaggaatacgtggattacatgccagtcatgaaaagatacagcgctccttccgagagtgaaggagttctgtaa

SEQ ID NO: 7862 - RNA, 9867 nt, synthetic construct
  misc_feature 1..9867: note = derived and/or modified CDS sequence (wt) from DENV-4__JQ915087__SS-prME
  source 1..9867: mol_type = other RNA
tcaacaatgacattgctgtgtttgattcccaccgtaatggcatttcacctgtcaacaagagacggcgaacccctcatgatagtggcaaaacacgaaagggggagacctctcttgttcaagacaacagaaggaatcaacaaatgcaccctcattgccatggacctgggtgagatgtgtgaagacactgtcacgtataaatgccctctactggttaacaccgaacctgaagacatcgattgctggtgcaatctcacgtccacctgggtcatgtacgggacgtgcacccagagcggagaacggaggcgagagaagcgctcagtagctttaacaccacattcaggaatgggattggaaacaagagctgagacatggatgtcatcggaaggggcttggaaacatgctcagagagtggaaagctggatactcagaaacccaggattcgcgctcctggcaggatttatggcttacatgattgggcaaacaggaatccagcgaattgttttctttgtcctaatgatgctagtcgccccatcctacggaatgcgatgcgtaggggtagggaacagagacttcgtggaaggagtctcgggtggagcatgggtcgacttggtgctagaacatggaggatgcgtcacaaccatggcccagggaaaaccaaccctggattttgaactgactaagacaacagctaaggaagtggctctgttgagaacctattgtattgaagcttcgatatcaaacataaccacagcaacaagatgtccaacgcaaggagagccttatctcaaagaggaacaagaccaacagtacatttgccggagagacgtggtagacagagggtggggcaatggctgtggcttgtttggaaaaggaggagttgtgacatgtgcgaagtttttatgctcggggaagataacaggcaatctggtccaaattgaaaaccttgaatacacggtagttgtgacagtccacaatggagacacccatgcagtaggaaatgacacatccaatcatggagtgacagccacgataactcccaggtcaccatcggtagaagttaaattgccggactatggagaactaacactcgactgtgaacccaggtctggaattgatttcaatgagatgatcctgatgaaaatgaaaaagaaaacgtggcttgtgcacaagcaatggtttttggacctacctctaccttggacagcaggagcagacacatcagaagttcattggaattacaaagagagaatggtgacattcaaggttcctcatgccaaaagacaggatgtgacagtgctaggatctcaggagggagctatgcactctgccctcgccggagcaacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtatgaaggcgctggagctccgtgtaaaatccccatagagataagagatgtgaacaaggagaaagtagttgggcgcatcatctcatctaccccttttgctgagaataccaacagcgtaatcaacatagaattagaacccccttttggggacagctacatagtgataggtgtaggagatagtgcattaacactccattggttcagaaaagggagctctattggcaagatgtttgagtccacatacagaggtgcaaaacgaatggccattctaggtgaaacagcttgggattttggttctgttggtggactgtttacatcactgggaaaggctgtacaccaagtttttggaagtgtgtatacaaccatgtttggaggggtctcatggatgattagaatcctaattgggttcttggtattgtggattggcacgaattcaagaaatacttcaatggcaatgacgtgcatagctgttggaggaatcactctgtttctaggtttcacagttcaagcagacatgggttgtgtggtgtcatggaatgggaaggaactaaaatgtggaagcggaatttttgtggttgacaacgtgcacacttggacagaacagtacaaattccaaccagagtccccagcgaggctagcgtctgcaatactgaatgcccacaaagatggggtctgtggaatcagatcaaccacgaggctggaaaatgttatgtggaagcaaataaccaacgagctaaactatgttctctgggaaggaggacatgacctcactgtagtggctggggacgtaaagggggtgttgaccaaaggcaagagagcactcacacctccagtgaatgatctgaaatattcatggaagacgtggggaaaagcaaaaatctttaccccagaagcaagaaatagcacatttttaatagacggaccagacacctccgaatgccccaatgaacgaagagcatggaacttttttgaggtagaagactatggatttggcatgtttacgaccaacatatggatgaaattccgagaaggaagttcagaagtgtgtgaccatagattaatgtcggcggcaatcaaagatcagaaagctgtgcatgccgacatgggttattggatagagagctcaaaaaaccagacctggcagatagagaaagcatccctcattgaggtgaaaacatgtctgtggcccaaaacccacacactgtggagcaatggggtgctggaaagtcagatgctcattccaagatcatatgcaggccctttttcacagcacaattaccgccagggctatgccacgcaaaccgcgggcccatggcacttaggcaaattggagatagactttggagaatgccccggaacaacagttaaaattcaggaagattgtgaccatagaggcccatctttgaggaccaccactgcatctggaaaactggttacgcaatggtgctgccgctcctgcacgatgcctcccttaaggttcttgggggaagacggatgttggtatgggatggagattaggcccttgagtgaaaaagaagagaacatggtcaaatcacaggtaacagccggacagggtacatcagaaactttttctatggggctgctatgcctgaccttgttcgtggaagaatgcttgaggagaagagtcactaggaaacacatgatattggttgtggtaatcaccttctgtgctattatcttaggaggtctcacatggatggacttactgcgagcccttatcatgttaggggacactatgtctggtagaataggaggacagattcacctagccatcatgacagtgttcaagatgtcaccaggatatgtgctgggtgtgtttttaagaaaacttacttcaagagagacagcgctaatggtaataggaatggccatgacaacggtgttttcaattccacatgacctcatggaactcattgatggaatatcattggggctgatattactaaaaatagtaacacactttgataacacccaagtgggaaccttagccctttccctgactttcataagatcaacaacaccattagtcatggcttggaggaccatcatggctgtgttcttcgtgatcacacttattcctttgtgcaggacaagctgtcttcaaaaacagtcccattgggtagaaataacagcacttatcttaggagcccaggctttgccagtgtacctaatgactctcatgaaaggagcctcaagaagatcttggcctcttaatgagggtataatggctgtgggtttggtgagcctcttaggaagcgccctcctaaagaatgatgttcctttagctggcccaatggtggcaggaggcttacttctagcggcttacgtaatgagtggcagctcagcagacctgtcactagagaaggctgccaatgtacagtgggatgaaatggcggacataactggctcaagcccaatcatagaagtgaagcaggatgaagatggctctttctccatacgggacgtcgaggaaaccaacatgataaccctcttggtgaaactggcgctgataacagtatcaggtctctaccccttggcaattccagtcacaatggcactatggtatatttggcaagtgaaaacacaaagatcaggagctctgtgggacgtcccctcgcccgctgccactcagaaagccacactgtctgaaggggtgtataggatcatgcaaagagggctgtttgggaaaactcaggttggagtagggatacacatggagggtgtattccacacaatgtggcacgtgacaagaggatcagtgatctgccatgagacagggagattagagccatcttgggctgacgtcaggaatgacatgatatcatacggtgggggatggaggctcggagacaaatgggataaagaagaagatgttcaggtcctagccatagaaccaggaaaaaatcctagacatgtccaaacgaaaccaggccttttcaagaccctaactggagaaattggagcagtaactctggatttcaaacctggaacgtctggctctcctatcatcaacaagaaagggaaagttattggactctatggaaatggagtagttaccaaatcaggtgattacgtcagtgccataacgcaagccgaaagaattggtgagccagattatgaagtagatgaggacatttttcgaaagaaaagattaactataatggacttacaccccggagctggaaagacaaaaagaattctcccatcaatagtcagagaagctttgaaaaggaggctgcgaaccttgattttggctcccacgagagtggtggcggccgagatggaagaggccctacgcggactgccaatccgctatcagaccccagctgtgaaatcagagcacacaggaagagagattgtagacctcatgtgccatgcaaccttcacaacgagacttttgtcatcaaccagggttccaaattacaaccttatagtgatggatgaagcacattttactgacccttgtagtgtcgcggctagaggatacatctcaaccagggtggaaatgggagaggcagcagctatcttcatgactgcaacccctcctggatcgatagatcccttcccccagagcaacagcccaatagaagacatcgagagggaaatccccgaaaggtcatggaacacagggttcgactggataacagactaccaagggaaaactgtgtggtttgttcccagcataaaagccggaaatgacatcgcaaattgtttgagaaagtcgggaaagagagtgatccagttgagcagaaaaacctttgacacagagtatccaaagacgaaactcacggattgggattttgtggtcaccacagacatatctgaaatgggggccaattttagagctgggagagtgatagaccccaggagatgcctcaagccagttatcctaacagatgggccagagagagttattctagcaggtccaatcccagtaactccagcaagtgccgctcagagaagagggcgaataggtaggaatccagcacaagaagatgaccaatatgttttctccggagacccactaaagaatgatgaagatcatgctcactggacagaagcaaagatgttgcttgacaatatctacacccctgaagggataattccaacattgtttggtccggaaagggaaaaaacccaagccattgatggagagtttcgcctcagaggggaacaaaggaagactttcgtggaattgatgaggagaggagaccttccggtgtggctgagctacaaggtagcttctgccggtatctcttacaaagaccgagaatggtgcttcacaggagaaaggaataaccaaattttagaagaaaacatggaggttgaaatctggactagagagggagaaaagaaaaagctaaggccaaaatggttagatgcacgtgtgtacgctgaccccatggctttgaaggatttcaaggagttcgccagtggaagaaagagcacaactcttgacatcctaacagagatcgccactttgccaacctacctttcctctaaggccaaactagcccttgacaacatagtcatgctccacacaacagaaaaaggagggagggcctaccaacacgccctgaacgaactcccggagtcactggaaacactcatgctcgtagccctactaggtgctatgacagccggtatcttcctgttttttatgcaggggaaaggaatagggaaattgtcaatgggtctgatagctatagctgtggccagtggcttgctctgggtagcggaaattcagccccagtggatagcagcttcaatcatactggagttttttcttatggtgctgttgataccagaaccagaaaaacaaaggaccccacaagacaatcaattgatctacgttatattgactattctcaccattattggtctcatagcagccaatgagatggggctgattgaaaaaacaaaaacggactttgggttctaccaggtaaaaacagaaaccaccattcttgatgtggatttgagaccagcctcagcatggacactctatgcagtggccaccactattctgactcccatgctgagacacaccatagagaacacgtctgccaacttatctctagcagccattgccaaccaggcagctgtcctaatgggacttggaaaaggatggccgctccacagaatggacctcggtgtgccgctgttagctatgggatgttattcccaagtgaacccaacaaccctgacagcatccctagtcatgcttttaatccattatgccataataggtccaggattgcaggcaaaagccacaagagaggcccagaaaaggacagctgctgggatcatgaagaaccccacggtggacgggataacagtaatagatttagaaccaatatcctatgacccaaaatttgaaaagcagttagggcaagtcatgctactagtcctgtgtgttggacaattgcttttgatgagaacaacctgggctctctgcgaagtattaactttggccacaggaccaatcatgaccttgtgggagggcaacccgggaaggttttggaacacgaccatagctgtatccacagccaacatttttagaggaagctacctggcgggagctggactagctttttcgctcataaagaatgcacaaacccctaggaggggaactgggaccacaggagagacactgggagagaagtggaagagacagctaaactcattagacagaaaagagtttgaagagtacaaaagaagtggaatattagaagtggataggactgaggccaagtctgccctaagagatggatctaaaatcaagcatgcggtgtccagagggtctagtaagatcagatggattgttgaaagagggatgataaagccaaaaggaaaggtcgtggatcttggttgcgggaggggaggatggtcctattacatggcgacactcaagaacgtgactgaagtgaaagggtatacaaaaggaggcccaggacatgaagaaccaattcccatggctacttatggctggaatttggtcaaactccattcaggggttgatgtgttctacaaacccactgagcaggtggacaccctgctctgtgacattggggagtcatcctccaatccaacaatagaggaaggaagaacattgagaatcttgaagatggtggagccatggctctcttcaaaacctgagttctgcatcaaagttctcaacccctacatgccgacagttatagaagagttggagaaactacagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacaatcattgggagaaggcttcagagattgcaagaagagcacaaagaaacctggcactatgaccaggaaaatccatacagaacctgggcgtatcatggaagctatgaagctccttcgacaggctcagcatcctccatggtgaacggggtagtaaaactgctgacaaaaccttgggatgtgattccaatggtgacccagttggccatgacagacacaaccccttttgggcaacaaagagtgttcaaggagaaggtggataccagaacaccacaaccaaaacttggcacacgaatgattatgaccacgacagccaattggttgtgggccctcctcgggaagaagaaaagtcccagactgtgcacaagggaagagttcatctcaaaagttaggtcaaatgcagccataggcgcagtctttcaagaagaacagggatggacatcagccagtgaagctgtgaatgacagccggttctgggaactggttgacaaagaaagggctctgcaccaggaaggaaaatgtgaatcgtgtgtctataacatgatggggaaacgtgagaaaaaattaggagagtttggtagggccaagggaagccgagcaatctggtacatgtggctgggggcgcggttcctggaatttgaagccctgggttttttgaatgaagatcactggtttagcagagaaaactcatggagtggagtggaaggagaaggcctgcacagtttgggatacatcttggaggacatagacaagaaggatggagacctgatatatgctgacgacacagcaggctgggacacgagaatcactgaggatgaccttttaaatgaagaactgatcacagaacagatggcccctcaccacaagaccctagccaaagccattttcaaactaacctatcaaaacaaagtggtgaaagtcctcagacccacaccgaaaggagcggtaatggacattatatccaggaaagaccaaagaggcagtggacaggttggaacatatggtttaaatacatttactaacatggaagttcaactcatccgccaaatggaagctgaaggagtcatcacacaagacgacatgcagaacccaaaagggttgaaagaaagagttgagaaatggctgaaagagtgtggcgtcgacaggttgaagaggatggcaatcagtggagatgattgcgtggtgaagcccctagatgagaggtttagcacctccctcctcttcttgaatgacatgggaaaggtgaggaaagacgtcccgcaatgggaaccatccaagggatggaaaaactggcaagaggttcccttttgctcccaccattttcacaagatcttcatgaaagatggccgctcactggttgttccatgcagaaaccaggatgaactgataggaagagccagaatctcgcagggggctggatggagcttgagagaaacagcctgtctgggcaaagcttacgcccagatgtggtcgcttatgtacttccatagaagggacctgcgcctagcctccatggccatatgctcagcagttccaactgaatggtttccaacaagcagaacaacatggtcaatccatgctcaacaccagtggatgaccactgaagacatgcttaaagtgtggaacagagtgtggatagaagacaaccccaatatgactgacaagactccagtccattcgtgggaagacataccttacctagggaaaagagaggatctgtggtgtggatccctgattggactttcttccagagccacctgggcgaagaacattcacacggccataacccaggtcaggaatctgatcggaaaagaggaatacgtggattacatgccagtcatgaaaagatacagcgctccttccgagagtgaaggagttctgtaa

SEQ ID NO: 7863 - RNA, 9867 nt, synthetic construct
  misc_feature 1..9867: note = derived and/or modified CDS sequence (wt) from DENV-4__JQ915089__SS-prME
  source 1..9867: mol_type = other RNA
tcaacaatgacattgctgtgtttgattcccaccgtaatggcatttcacctgtcaacaagagacggcgaacccctcatgatagtggcaaaacacgaaagggggagacctctcttgttcaagacaacagaaggaatcaacaaatgcaccctcattgccatggacctgggtgaaatgtgtgaagacactgtcacgtataaatgccctctactggttaacaccgaacctgaagacattgattgctggtgcaatctcacgtccacctgggtcatgtacgggacgtgcacccagagcggagagcggaggcgagagaagcgctcagtagctttaacaccacattcaggaatgggattggaaacaagagctgagacatggatgtcatcggaaggggcttggaaacatgctcagagagtggaaagctggatactcagaaacccaggattcgcgctcctggcaggatttatggcttacatgattgggcaaacaggaatccagcgaactgttttctttgtcctaatgatgctagttgccccatcctacggaatgcgatgcgtaggggtagggaacagagacttcgtggaaggagtctcgggtggagcatgggtcgacttggtgctagaacatggaggatgcgtcacaaccatggcccagggaaaaccaaccctggattttgaactgaccaagacaacagctaaggaagtggctctgttgagaacctattgtattgaagcttcgatatcaaacataaccacagcaacaagatgtccaacgcaaggagagccttatctcaaagaggaacaagaccaacagtacatttgccggagagacgtggtagacagagggtggggcaatggctgtggcttgtttggaaaaggaggagttgtgacatgtgcgaagtttttatgctcggggaagataacaggcaatctggtccaaattgaaaaccttgaatacacggtagttgtgacagtccacaatggagacacccatgcagtaggaaatgacacatccaatcatggagtgacagccacgataactcccaggtcaccatcggtagaagttaaattgccggactatggagaactaacacttgactgtgaacccaggtctggaattgatttcaatgagatgatcctgatgaaaatgaaaaagaaaacgtggcttgtgcacaagcaatggtttttggacctacctctaccttggacagcaggagcagacacatcagaagttcattggaattacaaagagagaatggtgacattcaaggttcctcatgccaaaagacaggatgtgacagtgctaggatctcaggagggagctatgcactctgccctcgccggagcaacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtatgaaggcgctggagctccgtgtaaaatccccatagagataagagatgtgaacaaggagaaagtagttgggcgcatcatctcatctaccccttttgctgagaataccaacagcgtaatcaacatagaattagaacccccttttggggacagctacatagtgataggtgttggagatagtgcattaacactccattggttcagaaaagggagctctattggcaagatgtttgagtccacatacagaggtgcaaaacgaatggccattctaggtgaaacagcttgggattttggttctgttggtggactgtttacatcactgggaaaggctgtacaccaagtttttggaagtgtgtatacaaccatgtttggaggggtctcatggatgattagaatcctaattgggttcttggtattgtggattggcacgaattcaagaaatacttcaatggcaatgacgtgcatagctgttggaggaatcactctgtttctaggtttcacagttcaagcagacatgggttgtgtggtgtcatggaatgggaaggaactaaaatgtggaagcggaatttttgtggttgacaacgtgcacacttggacagaacagtacaaattccaaccagagtccccagcgaggctagcgtctgcaatactgaatgcccacaaagatggggtctgtggaatcagatcaaccacgaggctggaaaatgttatgtggaagcaaataaccaacgagctaaactatgttctctgggaaggaggacatgacctcactgtagtggctggggacgtaaagggggtgttgaccaaaggcaagagagtactcacacctccagtgaatgatctgaaatattcatggaaaacgtggggaaaagcaaaaatctttaccccagaagcaagaaatagcacatttttaatagacggaccagacacctccgaatgccccaatgaacgaagagcatggaacttttttgaggtagaagactatggatttggcatgtttacgaccaacatatggatgaaattccgagaaggaagttcagaagtgtgtgaccatagattaatgtcggcggcaatcaaagatcagaaagctgtgcatgccgacatgggttattggatagagagctcaaaaaaccagacctggcagatagagaaagcatccctcattgaagtgaaaacatgtctgtggcccaaaacccacacactgtggagcaatggggtgctggaaagtcagatgctcattccaagatcatatgcaggccctttttcacagcacaattaccgccagggctatgccacgcaaaccgcgggcccatggcacttaggcaaattggagatagactttggagaatgccccggaacaacagttaaaattcaggaagattgtgaccatagaggcccatctttgaggaccaccactgcatctggaaaactggttacgcaatggtgctgccgctcctgcacgatgcctcccttaaggttcttgggggaagacggatgttggtatgggatggagattaggcccttgagtgaaaaagaagagaacatggtcaaatcacaggtaacagccggacagggtacatcagaaactttttccatggggctgctatgcctgaccttgttcgtggaagaatgcttgaggagaagagtcactaggaaacacatgatattggttgtggtaatcaccttctgtgctatcatcttaggaggtctcacatggatggacttactgcgagcccttatcatgttaggggacactatgtctggtagaataggaggacagattcacctagccatcatgacagtgttcaagatgtcaccaggatatgtgctgggtgtgtttttaagaaaacttacttcaagagagacagcgctaatggtaataggaatggccatgacaacggtgttttcaattccacatgacctcatggaactcattgatggaatatcattggggctgatattactaaaaatagtaacacactttgataacacccaagtgggaaccttagccctttccctgactttcataagatcaacaacaccattagtcatggcttggaggaccatcatggctgtgttcttcgtgatcacacttattcctttgtgcaggacaagctgtcttcaaaaacagtcccattgggtagaaataacagcacttatcttaggagcccaggctttgccagtgtacctaatgactctcatgaaaggagcctcaagcagatcttggcctcttaatgagggtataatggctgtgggtttggtgagcctcttaggaagcgccctcctaaagaatgatgttcctttagctggcccaatggtggcaggaggcttacttctagcggcttacgtaatgagtggcagctcagcagacctgtcactagagaaggctgccaatgtacagtgggatgaaatggcggacataactggctcaagcccaatcatagaagtgaagcaggatgaagatggctctttctccatacgggacgtcgaggaaaccaacatgataaccctcttggtgaaactggcgctgataacagtatcaggtctctaccccttggcaattccagtcacaatggcactatggtatatttggcaagtgaaaacacaaagatcaggagctctgtgggacgtcccctcgcccgctgccactcagaaagccacactgtctgaaggggtgtataggatcatgcaaagagggctgtttgggaaaactcaggttggagtagggatacacatggaaggtgtgttccacacaatgtggcacgtgacaagaggatcagtgatctgccatgagacagggagattagagccatcttgggctgacgttaggaatgacatgatatcatacggtgggggatggaggctcggagacaaatgggataaagaagaagatgttcaggtcctagccatagaaccaggaaaaaatcctagacatgtccaaacgaaaccaggccttttcaagaccctaactggagaaattggagcagtaactctggatttcaaacctggaacgtctggctctcctatcatcaacaagaaagggaaagttattggactctatggaaatggagtagttaccaaatcaggtgattacgtcagtgccataacgcaagccgaaagaattggtgagccagattatgaaatagatgaggacatttttcgaaagaaaagattaactataatggacttacaccccggagctggaaagacaaaaagaattctcccatcaatagtcagagaagctttgaaaaggaggctgcgaaccttgattttggctcccacgagagtggtggcggccgagatggaagaggccctacgcggactgccaatccgctatcagaccccagctgtgaaatcagagcacacaggaagagagattgtagacctcatgtgccatgcaaccttcacaacgagacttttgtcatcaaccagggttccaaattacaaccttatagtgatggatgaagcacattttactgacccttgtagtgtcgcggctagaggatacatctcaaccagggtggaaatgggagaggcagcagctatcttcatgactgcaacccctcctggatcgatagatcccttcccccagagcaacagcccaatagaagacatcgagagggaaatccccgaaaggtcatggaacacagggttcgactggataacagactaccaagggaaaactgtgtggtttgttcccagcataaaagccggaaatgacatcgcaaattgtttgagaaagtcgggaaagagagtgatccagttgagcagaaaaacctttgacacagagtatccaaagacgaagctcacggactgggattttgtggtcaccacagacatatctgaaatgggggccaattttagagctgggagagtgatagaccccaggagatgcctcaagccagttatcctaacagatgggccagagagagttattctagcaggtccaatcccagtaactccagcaagtgccgctcagagaagagggcgaataggtaggaatccagcacaagaagatgaccaatatgttttctccggagacccactaaagaatgatgaagatcatgctcactggacagaagcaaagatgttgcttgacaatatctacacccctgaagggataattccaacattgtttggtccggaaagggaaaaaacccaagccattgatggagagtttcgcctcagaggggaacagaggaagactttcgtggaattgatgaggagaggagaccttccggtgtggctgagctacaaggtagcttctgctggtatctcttataaagaccgagaatggtgcttcacaggagaaaggaataaccaaattttagaagaaaacatggaggttgaaatctggactagagagggagaaaagaaaaagctaaggccaaaatggttagatgcacgtgtgtacgctgaccccatggctttgaaggatttcaaggagttcgccagtggaagaaagagcacaactcttgacatcctaacagagatcgccactttgccaacctacctttcctctaaggccaaactagcccttgacaacatagtcatgctccacacaacagaaaaaggagggagagcctaccaacacgccctgaacgaactcccggagtcactggaaacactcatgctcgtagccctactaggtgctatgacagccggtatcttcctgttttttatgcaggggaaaggaatagggaaattgtcaatgggtctgatagctatagctgtggccagtggcttgctctgggtagcggaaattcagccccagtggatagcagcttcaatcatactagagttttttcttatggtgctgttgataccagaaccagaaaaacaaaggaccccacaagacaatcaattgatctacgttatattgactattctcaccattattggtctcatagcagccaatgagatggggctgattgaaaaaacaaaaacggactttgggttctaccaggtaaaaacagaaaccaccattcttgatgtggatttgagaccagcctcagcatggacactctatgcagtggccaccactattctgactcccatgctgagacacaccatagagaacacgtctgccaacttatctctagcagccattgccaaccaggcagctgtcctaatgggacttggaaaaggatggccgctccacagaatggacctcggtgtgccgctgttagctatgggatgttattcccaagtgaacccaacaaccctgacagcatccctagtcatgcttttaatccattatgccataataggtccaggattgcaggcaaaagccacaagagaggcccagaaaaggacagctgctgggatcatgaagaaccccacggtggacgggataacagtaatagatttagagccaatatcctatgacccaaaatttgaaaagcagttagggcaagtcatgctactagtcctgtgtgttggacaattacttttgatgagaacaacctgggctctctgcgaagtattaactttggccacaggaccaatcatgaccttgtgggagggcaacccgggaaggttttggaacacgaccatagctgtatccacagccaacatttttagaggaagctacctggcgggagctggactagctttttcgctcataaagaatgcacaaacccctaggaggggaactgggaccacaggagagacactgggagagaagtggaagagacagctaaactcattagacagaaaagagtttgaagagtacaaaagaagtggaatattagaagtggataggactgaggccaagtctgccctaagagatggatctaaaatcaagcatgcggtgtccagagggtctagtaagatcagatggattgttgaaagagggatgataaagccaaaaggaaaggtcgtggatcttggttgcgggaggggaggatggtcctattacatggcgacactcaagaacgtgactgaagtgaaagggtatacaaaaggaggcccaggacatgaagaaccaattcccatggctacttatggctggaatttggtcaaactccattcaggagttgatgtgttctacaaacccactgagcaggtggacaccctgctctgtgacattggggagtcatcctccaatccaacaatagaggaaggaagaacattgagaatcttgaagatggtggagccatggctctcttcaaaacctgagttctgcatcaaagttctcaacccctacatgccgacagttatagaagagttggagaaactacagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacaatcattgggagaaggcttcagagattgcaagaagagcacaaagaaacctggcactatgaccaggaaaatccatacagaacctgggcgtatcatggaagctatgaagctccttcgacaggctcagcatcctccatggtgaacggggtagtaaaactgctgacaaaaccttgggatgtgattccaatggtgacccagttggccatgacagacacaaccccttttgggcaacaaagagtgttcaaggagaaggtggataccagaacaccacaaccaaaacttggcacacgaatgattatgaccacgacagccaattggttgtgggccctcctcgggaagaagaaaagtcccagactgtgcacaagggaagagttcatctcaaaagttaggtcaaatgcagccataggcgcagtctttcaagaagaacagggatggacatcagccagtgaagctgtgaatgacagccggttctgggaactggttgacaaagaaagggctctgcaccaggaaggaaaatgtgaatcgtgtgtctataacatgatggggaaacgtgagaaaaaattaggagagtttggtagggccaagggaagccgagcaatctggtacatgtggctgggggcgcggttcctggaatttgaagccctgggttttttgaatgaagatcactggtttagcagagaaaactcatggagtggagtggaaggagaaggcctgcacagattgggatacatcttggaggacatagacaagaaggatggagacctgatatatgctgacgacacagcaggctgggacacgagaatcactgaggatgaccttttaaatgaagaactgatcacagaacagatggcccctcaccacaagaccctagccaaagccattttcaaactaacctatcaaaacaaagtggtgaaagtcctcagacccacaccgaaaggagcggtaatggacattatatccaggaaagaccaaagaggcagtggacaggttggaacatatggtttaaatacattcactaacatggaagttcaactcatccgccaaatggaagctgaaggagtcatcacacaagacgacatgcagaacccaaaagggttgaaagaaagagttgagaaatggctgaaagagtgtggcgtcgacaggttgaagaggatggcaatcagtggagatgattgcgtggtgaagcccctagatgagaggtttagcacctccctcctcttcttgaatgacatgggaaaggtgaggaaagacgtcccgcaatgggaaccatccaagggatggaaaaactggcaagaggttcccttttgctcccaccattttcacaagatcttcatgaaagatggccgctcactggttgttccatgcagaaaccaggatgaactgataggaagagccagaatctcgcagggggctggatggagcttgagagaaacagcctgtctgggcaaagcttacgcccagatgtggtcgcttatgtacttccatagaagggacctgcgcctagcctccatggccatatgctcagcagttccaactgaatggtttccaacaagcagaacaacatggtcaatccatgctcaacaccagtggatgaccactgaagatatgcttaaagtgtggaacagagtgtggatagaagacaaccccaatatgactgacaagactccagtccattcgtgggaagacataccttacctagggaaaagagaggatctgtggtgtggatccctgattggactttcttccagagccacctgggcgaagaacattcacacggccataacccaggtcaggaatctgatcggaaaagaggaatacgtggattacatgccagtcatgaaaagatacagcgctccttccgagagtgaaggagttctgtaa

SEQ ID NO: 7864 - RNA, 9867 nt, synthetic construct
  misc_feature 1..9867: note = derived and/or modified CDS sequence (wt) from DENV-4__JQ915082__SS-prME
  source 1..9867: mol_type = other RNA
tcaacaatgacattgctgtgtttgattcccaccgtaatggcatttcacctgtcaacaagagacggcgaacccctcatgatagtggcaaaacacgaaagggggagacctctcttgttcaagacaacagaaggaatcaacaaatgcaccctcattgccatggacctgggtgaaatgtgtgaagacactgtcacgtataaatgccctctactggttaacaccgaacctgaagacatcgattgctggtgcaatctcacgtccacctgggtcatgtacgggacgtgcacccagagcggagaacggaggcgagagaagcgctcagtagctttaacaccacattcaggaatgggattggaaacaagagctgagacatggatgtcatcggaaggggcttggaaacatgctcagagagtggaaagctggatactcagaaacccaggattcgcgctcctggcaggatttatggcttacatgattgggcaaacaggaatccagcgaattgttttctttgtcctaatgatgctagtcgccccatcctacggaatgcgatgcgtaggggtagggaacagagacttcgtggaaggagtctcgggtggagcatgggtcgacttggtgctagaacatggaggatgcgtcacaaccatggcccagggaaaaccaaccctggattttgaactgaccaagacaacagctaaggaagtggctctgttgagaacctattgtattgaagcttcgatatcaaacataaccacagcaacaagatgtccaacgcaaggagagccttatctcaaagaggaacaagaccaacagtacatttgccggagagacgtggtagacagagggtggggcaatggctgtggcttgtttggaaaaggaggagttgtgacatgtgcgaagtttttatgctcggggaagataacaggcaatctggtccaaattgaaaaccttgaatacacggtagttgtgacagtccacaatggagacacccatgcagtaggaaatgacacatccaatcatggagtgacagccacgataactcccaggtcaccatcggtagaagttaaattgccggactatggagaactaacactcgactgtgaacccaggtctggaattgatttcaatgagatgatcctgatgaaaatgaaaaagaaaacgtggcttgtgcacaagcaatggtttttggacctacctctaccttggacagcaggagcagacacatcagaagttcattggaattacaaagagagaatggtgacattcaaggttcctcatgccaaaagacaggatgtgacagtgctaggatctcaggagggagctatgcactctgccctcgccggagcaacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtatgaaggcgctggagctccgtgtaaaatccccatagagataagagatgtgaacaaggagaaagtagttgggcgcatcatctcatctaccccttttgctgagaataccaacagcgtaatcaacatagaattagaacccccttttggggacagctacatagtgataggtgtaggagatagtgcattaacactccattggttcagaaaagggagctctattggcaagatgtttgagtccacatacagaggtgcaaaacgaatggccattctaggtgaaacagcttgggattttggttctgttggtggactgtttacatcactgggaaaggctgtacaccaagtttttggaagtgtgtatacaaccatgtttggaggggtctcatggatgattagaatcctaattgggttcttggtattgtggattggcacgaattcaagaaatacttcaatggcaatgacgtgcatagctgttggaggaatcactctgtttctaggtttcacagttcaagcagacatgggttgtgtggtgtcatggaatgggaaggaactaaaatgtggaagcggaatttttgtggttgacaacgtgcacacttggacagaacagtacaaattccaaccagagtccccagcgaggctagcgtctgcaatactgaatgcccacaaagatggggtctgtggaatcagatcaaccacgaggctggaaaatgttatgtggaagcaaataaccaacgagctaaactatgttctctgggaaggaggacatgacctcactgtagtggctggggacgtaaagggggtgttgaccaaaggcaagagagcactcacacctccagtgaatgatctgaaatattcatggaagacgtggggaaaagcaaaaatctttaccccagaagcaagaaatagcacatttttaatagacggaccagacacctccgaatgccccaatgaacgaagagcatggaacttttttgaggtagaagactatggatttggcatgtttacgaccaacatatggatgaaattccgagaaggaagttcagaagtgtgtgaccatagattaatgtcggcggcaatcaaagatcagaaagctgtgcatgccgacatgggttattggatagagagctcaaaaaaccagacctggcagatagagaaagcatccctcattgaagtgaaaacatgtctgtggcccaaaacccacacactgtggagcaatggggtgctggaaagtcagatgctcattccaagatcatatgcaggccctttttcacagcacaattaccgccagggctatgccacgcaaaccgcgggcccatggcacttaggcaaattggagatagactttggagaatgccccggaacaacagttaaaattcaggaagattgtgaccatagaggcccatctttgaggaccaccactgcatctggaaaactggttacgcaatggtgctgccgctcctgcacgatgcctcccttaaggttcttgggggaagacggatgttggtatgggatggagattaggcccttgagtgaaaaagaagagaacatggtcaaatcacaggtaacagccggacagggtacatcagaaactttttctatggggctgctatgcctgaccttgttcgtggaagaatgcttgaggagaagagtcactaggaaacacatgatattggttgtggtaatcaccttctgtgctatcatcttaggaggtctcacatggatggacttactgcgagcccttatcatgttaggggacactatgtctggtagaataggaggacagattcacctagccatcatgacagtgttcaagatgtcaccaggatatgtgctgggtgtgtttttaagaaaacttacttcaagagagacagcgctaatggtaataggaatggccatgacaacggtgttttcaattccacatgacctcatggaactcattgatggaatatcattggggctgatattactaaaaatagtaacacactttgataacacccaagtgggaaccttagccctttccctgactttcataagatcaacaacaccattagtcatggcttggaggaccatcatggctgtgttcttcgtgatcacacttattcctttgtgcaggacaagctgtcttcaaaaacagtcccattgggtagaaataacagcacttatcttaggagcccaggctttgccagtgtacctaatgactctcatgaaaggagcctcaagaagatcttggcctcttaatgagggtataatggctgtgggtttggtgagcctcttaggaagcgccctcctaaagaatgatgttcctttagctggcccaatggtggcaggaggcttacttctagcggcttacgtaatgagtggcagctcagcagacctgtcactagagaaggctgccaatgtacagtgggatgaaatggcggacataactggctcaagcccaatcatagaagtgaagcaggatgaagatggctctttctccatacgggacgtcgaggaaaccaacatgataaccctcttggtgaaactggcgctgataacagtatcaggtctctaccccttggcaattccagtcacaatggcactatggtatatttggcaagtgaaaacacaaagatcaggagctctgtgggacgtcccctcgcccgctgccactcagaaagccacactgtctgaaggggtgtataggatcatgcaaagagggctgtttgggaaaactcaggttggagtagggatacacatggaaggtgtattccacacaatgtggcacgtgacaagaggatcagtgatctgccatgagacagggagattagagccatcttgggctgacgtcaggaatgacatgatatcatacggtgggggatggaggctcggagacaaatgggataaagaagaagatgttcaggtcctagccatagaaccaggaaaaaatcctagacatgtccaaacgaaaccaggccttttcaagaccctaactggagaaattggagcagtaactctggatttcaaacctggaacgtctggctctcctatcatcaacaagaaagggaaggttattggactctatggaaatggagtagtcaccaaatcaggtgattacgttagtgccataacgcaagccgaaagaattggtgagccagattatgaagtagatgaggacatttttcgaaagaaaagattaactataatggacttacaccccggagctggaaagacaaaaagaattctcccatcaatagtcagagaagctttgaaaaggaggctgcgaaccttgattttggctcccacgagagtggtggcggccgagatggaagaggccctacgcggactgccaatccgctatcagaccccagctgtgaaatcagagcacacaggaagagagattgtagacctcatgtgccatgcaaccttcacaacgagacttttgtcatcaaccagggttccaaattacaaccttatagtgatggatgaagcacattttactgacccttgtagtgtcgcggctagaggatacatctcaaccagggtggaaatgggagaggcagcagctatcttcatgactgcaacccctcctggatcgatagatcccttcccccagagcaacagcccaatagaagacatcgagagggaaatccccgaaaggtcatggaacacagggttcgactggataacagactaccaagggaaaactgtgtggtttgttcccagcataaaagccggaaatgacatcgcaaattgtttgagaaagtcgggaaagagagtgatccagttgagcagaaaaacctttgacacagagtatccaaagacgaaactcacggactgggattttgtggtcaccacagacatatctgaaatgggggccaattttagagctgggagagtgatagaccccaggagatgcctcaagccagttatcctaacagatgggccagagagagttattctagcaggtccaatcccagtaactccagcaagtgccgctcagagaagagggcgaataggtaggaatccagcacaagaagatgaccaatatgttttctccggagacccactaaagaatgatgaagatcatgctcactggacagaagcaaagatgttgcttgacaatatctacacccctgaagggataattccaacattgtttggtccggaaagggaaaaaacccaagccattgatggagagtttcgcctcagaggggaacaaaggaagactttcgtggaattgatgaggagaggagaccttccggtgtggctgagctacaaggtagcttctgccggtatctcttacaaagaccgagaatggtgcttcacaggagaaaggaataaccaaattttagaagaaaacatggaggttgaaatctggactagagagggagaaaagaaaaagctaaggccaaaatggttagatgcacgtgtgtacgctgaccccatggctttgaaggatttcaaggagttcgccagtggaagaaagagcacaactcttgacatcctaacagagatcgccactttgccaacctacctttcctctaaggccaaactagcccttgacaacatagtcatgctccacacaacagaaaaaggagggagggcctaccaacacgccctgaacgaactcccggagtcactggaaacactcatgctcgtagccctactaggtgctatgacagccggtatcttcctgttttttatgcaggggaaaggaatagggaaattgtcaatgggtctgatagctatagctgtggccagtggcttgctctgggtagcggaaattcagccccagtggatagcagcttcaatcatactggagttttttcttatggtgctgttgataccagaaccagaaaaacaaaggaccccacaagacaatcaattgatctacgttatattgactattctcaccattattggtctcatagcagccaatgagatggggctgattgaaaaaacaaaaacggactttgggttctaccaggtaaaaacagaaaccaccattcttgatgtggatttgagaccagcctcagcatggacactctatgcagtggccaccactattctgactcccatgctgagacacaccatagagaacatgtctgccaacttatctctagcagccattgccaaccaggcagctgtcctaatgggacttggaaaaggatggccgctccacagaatggacctcggtgtgccgctgttagctatgggatgttattcccaagtgaacccaacaaccctgacagcatccctagtcatgcttttaatccattatgccataataggtccaggattgcaggcaaaagccacaagagaggcccagaaaaggacagctgctgggatcatgaagaaccccacggtggacgggataacagtaatagatttagaaccaatatcctatgacccaaaatttgaaaagcagttagggcaagtcatgctactagtcctgtgtgttggacaactacttttgatgagaacaacctgggctctctgcgaagtattaactttggccacaggaccaatcataaccttgtgggagggcaacccgggaaggttttggaacacgaccatagctgtatccacagccaacatttttagaggaagctacctggcgggagctggactagctttttcgctcataaagaatgcacaaacccctaggaggggaactgggaccacaggagagacactgggagagaagtggaagagacagctaaactcattagacagaaaagagtttgaagagtacaaaagaagtggaatattagaagtggataggactgaggccaagtctgccctaagagatggatctaaaatcaagcatgcggtgtccagagggtctagtaagatcagatggattgttgaaagagggatgataaagccaaaaggaaaggtcgtggatcttggttgcgggaggggaggatggtcctattacatggcgacactcaagaacgtgactgaagtgaaagggtatacaaaaggaggcccaggacatgaagaaccaattcccatggctacttatggctggaatttggtcaaactccattcaggggttgatgtgttctacaaacccactgagcaggtggacaccctgctctgtgacattggggagtcatcctccaatccaacaatagaggaaggaagaacattgagaatcttgaagatggtggagccatggctctcttcaaaacctgagttctgcatcaaagttctcaacccctacatgccgacagttatagaagagttggagaaactacagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacaatcattgggagaaggcttcagagattgcaagaagagcacaaagaaacctggcactatgaccaggaaaatccatacagaacctgggcgtatcatggaagctatgaagctccttcgacaggctcagcatcctccatggtgaacggggtagtaaaactgctgacaaaaccttgggatgtgattccaatggtgacccagttggccatgacagacacaaccccttttgggcaacaaagagtgttcaaggagaaggtggataccagaacaccacaaccaaaacttggcacacgaatgattatgaccacgacagccaattggttgtgggccctcctcgggaagaagaaaagtcccagactgtgcacaagggaagagttcatctcaaaagttaggtcaaatgcagccataggcgcagtctttcaagaagaacagggatggacatcagccagtgaagctgtgaatgacagccggttctgggaactggttgacaaagaaagggctctgcaccaggaaggaaaatgtgaatcgtgtgtctataacatgatggggaaacgtgagaaaaaattaggagagtttggtagggccaagggaagccgagcaatctggtacatgtggctgggggcgcggttcctggaatttgaagccctgggttttttgaatgaagatcactggtttagcagagaaaactcatggagtggagtggaaggagaaggcctgcacagattgggatacatcttggaggacatagacaagaaggatggagacctgatatatgctgacgacacagcaggctgggacacgagaatcactgaggatgaccttttaaatgaagaactgatcacagaacagatggcccctcaccacaagaccctagccaaagccattttcaaactaacctatcaaaacaaagtggtgaaagtcctcagacccacaccgaaaggagcggtaatggacattatatccaggaaagaccaaagaggcagtggacaggttggaacatatggtttaaatacattcactaacatggaagttcaactcatccgccaaatggaagctgaaggagtcatcacacaagacgacatgcagaacccaaaagggttgaaagaaagagttgagaaatggctgaaagagtgtggcgtcgacaggttgaagaggatggcaatcagtggagatgattgcgtggtgaagcccctagatgagaggtttagcacctccctcctcttcttgaatgacatgggaaaggtgaggaaagacgtcccgcaatgggatccatccaagggatggaaaaactggcaagaggttcccttttgctcccaccattttcacaagatcttcatgaaagatggccgctcactggttgttccatgcagaaaccaggatgaactgataggaagagccagaatctcgcagggggctggatggagcttgagagaaacagcctgtctgggcaaagcttacgcccagatgtggtcgcttatgtacttccatagaagggacctgcgcctagcctccatggccatatgctcagcagttccaactgaatggtttccaacaagcagaacaacatggtcaatccatgctcaacaccagtggatgaccactgaagatatgcttaaagtgtggaacagagtgtggatagaagacaaccccaacatgactgacaagactccagtccattcgtgggaagacataccttacctagggaaaagagaggatctgtggtgtggatccctgattggactttcttccagagccacctgggcgaagaacattcacacggccataacccaggtcaggaatctgatcggaaaagaggaatacgtggattacatgccagtcatgaaaagatacagcgctccttccgagagtgaaggagttctgtaa

SEQ ID NO: 7865 - RNA, 9867 nt, synthetic construct
  misc_feature 1..9867: note = derived and/or modified CDS sequence (wt) from DENV-4__JQ915081__SS-prME
  source 1..9867: mol_type = other RNA
tcaacaatgacattgctgtgtttgattcccaccgtaatggcatttcacctgtcaacaagagacggcgaacccctcatgatagtggcaaaacacgaaagggggagacctctcttgttcaagacaacagaaggaatcaacaaatgcaccctcattgccatggacctgggtgaaatgtgtgaagacactgtcacgtataaatgccctctactggttaacaccgaacctgaagacatcgattgctggtgcaatctcacgtccacctgggtcatgtacgggacgtgcacccagagcggagaacggaggcgagagaagcgctcagtagctttaacaccacattcaggaatgggattggaaacaagagctgagacatggatgtcatcggaaggggcttggaaacatgctcagagagtggaaagctggatactcagaaacccaggattcgcgctcctggcaggatttatggcttacatgattgggcaaacaggaatccagcgaattgttttctttgtcctaatgatgctagtcgccccatcctacggaatgcgatgcgtaggggtagggaacagagacttcgtggaaggagtctcgggtggagcatgggtcgacttggtgctagaacatggaggatgcgtcacaaccatggcccagggaaaaccaaccctggattttgaactgaccaagacaacagctaaggaagtggctctgttgagaacctattgtattgaagcttcgatatcaaacataaccacagcaacaagatgtccaacgcaaggagagccttatctcaaagaggaacaagaccaacagtacatttgccggagagacgtggtagacagagggtggggcaatggctgtggcttgtttggaaaaggaggagttgtgacatgtgcgaagtttttatgctcggggaagataacaggcaatctggtccaaattgaaaaccttgaatacacggtagttgtgacagtccacaatggagacacccatgcagtaggaaatgacacatccaatcatggagtgacagccacgataactcccaggtcaccatcggtagaagttaaattgccggactatggagaactaacactcgactgtgaacccaggtctggaattgatttcaatgagatgatcctgatgaaaatgaaaaagaaaacgtggcttgtgcacaagcaatggtttttggacctacctctaccttggacagcaggagcagacacatcagaagttcattggaattacaaagagagaatggtgacattcaaggttcctcatgccaaaagacaggatgtgacagtgctaggatctcaggagggagctatgcactctgccctcgccggagcaacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtatgaaggcgctggagctccgtgtaaaatccccatagagataagagatgtgaacaaggagaaagtagttgggcgcatcatctcatctaccccttttgctgagaataccaacagcgtaatcaacatagaattagaacccccttttggggacagctacatagtgataggtgtaggagatagtgcattaacactccattggttcagaaaagggagctctattggcaagatgtttgagtccacatacagaggtgcaaaacgaatggccattctaggtgaaacagcttgggattttggttctgttggtggactgtttacatcactgggaaaggctgtacaccaagtttttggaagtgtgtatacaaccatgtttggaggggtctcatggatgattagaatcctaattgggttcttggtattgtggattggcacgaattcaagaaatacttcaatggcaatgacgtgcatagctgttggaggaatcactctgtttctaggtttcacagttcaagcagacatgggttgtgtggtgtcatggaatgggaaggaactaaaatgtggaagcggaatttttgtggttgacaacgtgcacacttggacagaacagtacaaattccaaccagagtccccagcgaggctagcgtctgcaatactgaatgcccacaaagatggggtctgtggaatcagatcaaccacgaggctggaaaatgttatgtggaagcaaataaccaacgagctaaactatgttctctgggaaggaggacatgacctcactgtagtggctggggacgtaaagggggtgttgaccaaaggcaagagagcactcacacctccagtgaatgatctgaaatattcatggaagacgtggggaaaagcaaaaatctttaccccagaagcaagaaatagcacatttttaatagacggaccagacacctccgaatgccccaatgaacgaagagcatggaacttttttgaggtagaagactatggatttggcatgtttacgaccaacatatggatgaaattccgagaaggaagttcagaagtgtgtgaccatagattaatgtcggcggcaatcaaagatcagaaagctgtgcatgccgacatgggttattggatagagagctcaaaaaaccagacctggcagatagagaaagcatccctcattgaagtgaaaacatgtctgtggcccaaaacccacacactgtggagcaatggggtgctggaaagtcagatgctcattccaagatcatatgcaggccctttttcacagcacaattaccgccagggctatgccacgcaaaccgcgggcccatggcacttaggcaaattggagatagactttggagaatgccccggaacaacagttaaaattcaggaagattgtgaccatagaggcccatctttgaggaccaccactgcatctggaaaactggttacgcaatggtgctgccgctcctgcacgatgcctcccttaaggttcttgggggaagacggatgttggtatgggatggagattaggcccttgagtgaaaaagaagagaacatggtcaaatcacaggtaacagccggacagggtacatcagaaactttttctatggggctgctatgcctgaccttgttcgtggaagaatgcttgaggagaagagtcactaggaaacacatgatattggttgtggtaatcaccttctgtgctatcatcttaggaggtctcacatggatggacttactgcgagcccttatcatgttaggggacactatgtctggtagaataggaggacagattcacctagccatcatgacagtgttcaagatgtcaccaggatatgtgctgggtgtgtttttaagaaaacttacttcaagagagacagcgctaatggtaataggaatggccatgacaacggtgttttcaattccacatgacctcatggaactcattgatggaatatcattggggctgatattactaaaaatagtaacacactttgataacacccaagtgggaaccttagccctttccctgactttcataagatcaacaacaccattagtcatggcttggaggaccatcatggctgtgttcttcgtgatcacacttattcctttgtgcaggacaagctgtcttcaaaaacagtcccattgggtagaaataacagcacttatcttaggagcccaggctttgccagtgtacctaatgactctcatgaaaggagcctcaagaagatcttggcctcttaatgagggtataatggctgtgggtttggtgagcctcttaggaagcgccctcctaaagaatgatgttcctttagctggcccaatggtggcaggaggcttacttctagcggcttacgtaatgagtggcagctcagcagacctgtcactagagaaggctgccaatgtacagtgggatgaaatggcggacataactggctcaagcccaatcatagaagtgaagcaggatgaagatggctctttctccatacgggacgtcgaggaaaccaacatgataaccctcttggtgaaactggcgctgataacagtatcaggtctctaccccttggcaattccagtcacaatggcactatggtatatttggcaagtgaaaacacaaagatcaggagctctgtgggacgtcccctcgcccgctgccactcagaaagccacactgtctgaaggggtgtataggatcatgcaaagagggctgtttgggaaaactcaggttggagtagggatacacatggaaggtgtattccacacaatgtggcacgtgacaagaggatcagtgatctgccatgagacagggagattagagccatcttgggctgacgtcaggaatgacatgatatcatacggtgggggatggaggctcggagacaaatgggataaagaagaagatgttcaggtcctagccatagaaccaggaaaaaatcctagacatgtccaaacgaaaccaggccttttcaagaccctaactggagaaattggagcagtaactctggatttcaaacctggaacgtctggctctcctatcatcaacaagaaagggaaagttattggactctatggaaatggagtagtcaccaaatcaggtgattacgttagtgccataacgcaagccgaaagaattggtgagccagattatgaagtagatgaggacatttttcgaaagaaaagattaactataatggacttacaccccggagctggaaagacaaaaagaattctcccatcaatagtcagagaagctttgaaaaggaggctgcgaaccttgattttggctcccacgagagtggtggcggccgagatggaagaggccctacgcggactgccaatccgctatcagaccccagctgtgaaatcagagcacacaggaagagagattgtagacctcatgtgccatgcaaccttcacaacgagacttttgtcatcaaccagggttccaaattacaaccttatagtgatggatgaagcacattttactgacccttgtagtgtcgcggctagaggatacatctcaaccagggtggaaatgggagaggcagcagctatcttcatgactgcaacccctcctggatcgatagatcccttcccccagagcaacagcccaatagaagacatcgagagggaaatccccgaaaggtcatggaacacagggttcgactggataacagactaccaagggaaaactgtgtggtttgttcccagcataaaagccggaaatgacatcgcaaattgtttgagaaagtcgggaaagagagtgatccagttgagcagaaaaacctttgacacagagtatccaaagacgaaactcacggactgggattttgtggtcaccacagacatatctgaaatgggggccaattttagagctgggagagtgatagaccccaggagatgcctcaagccagttatcctaacagatgggccagagagagttattctagcaggtccaatcccagtaactccagcaagtgccgctcagagaagagggcgaataggtaggaatccagcacaagaagatgaccaatatgttttctccggagacccactaaagaatgatgaagatcatgctcactggacagaagcaaagatgttgcttgacaatatctacacccctgaagggataattccaacattgtttggtccggaaagggaaaaaacccaagccattgatggagagtttcgcctcagaggggaacaaaggaagactttcgtggaattgatgaggagaggagaccttccggtgtggctgagctacaaggtagcttctgccggtatctcttacaaagaccgagaatggtgcttcacaggagaaaggaataaccaaattttagaagaaaacatggaggttgaaatctggactagagagggagaaaagaaaaagctaaggccaaaatggttagatgcacgtgtgtacgctgaccccatggctttgaaggatttcaaggagttcgccagtggaagaaagagcacaactcttgacatcctaacagagatcgccactttgccaacctacctttcctctaaggccaaactagcccttgacaacatagtcatgctccacacaacagaaaaaggagggagggcctaccaacacgccctgaacgaactcccggagtcactggaaacactcatgctcgtagccctactaggtgctatgacagccggtatcttcctgttttttatgcaggggaaaggaatagggaaattgtcaatgggtctgatagctatagctgtggccagtggcttgctctgggtagcggaaattcagccccagtggatagcagcttcaatcatactggagttttttcttatggtgctgttgataccagaaccagaaaaacaaaggaccccacaagacaatcaattgatctacgttatattgactattctcaccattattggtctcatagcagccaatgagatggggctgattgaaaaaacaaaaacggactttgggttctaccaggtaaaaacagaaaccaccattcttgatgtggatttgagaccagcctcagcatggacactctatgcagtggccaccactattctgactcccatgctgagacacaccatagagaacatgtctgccaacttatctctagcagccattgccaaccaggcagctgtcctaatgggacttggaaaaggatggccgctccacagaatggacctcggtgtgccgctgttagctatgggatgttattcccaagtgaacccaacaaccctgacagcatccctagtcatgcttttaatccattatgccataataggtccaggattgcaggcaaaagccacaagagaggcccagaaaaggacagctgctgggatcatgaagaaccccacggtggacgggataacagtaatagatttagaaccaatatcctatgacccaaaatttgaaaagcagttagggcaagtcatgctactagtcctgtgtgttggacaactacttttgatgagaacaacctgggctctctgcgaagtattaactttggccacaggaccaatcataaccttgtgggagggcaacccgggaaggttttggaacacgaccatagctgtatccacagccaacatttttagaggaagctacctggcgggagctggactagctttttcgctcataaagaatgcacaaacccctaggaggggaactgggaccacaggagagacactgggagagaagtggaagagacagctaaactcattagacagaaaagagtttgaagagtacaaaagaagtggaatattagaagtggataggactgaggccaagtctgccctaagagatggatctaaaatcaagcatgcggtgtccagagggtctagtaagatcagatggattgttgaaagagggatgataaagccaaaaggaaaggtcgtggatcttggttgcgggaggggaggatggtcctattacatggcgacactcaagaacgtgactgaagtgaaagggtatacaaaaggaggcccaggacatgaagaaccaattcccatggctacttatggctggaatttggtcaaactccattcaggggttgatgtgttctacaaacccactgagcaggtggacaccctgctctgtgacattggggagtcatcctccaatccaacaatagaggaaggaagaacattgagaatcttgaagatggtggagccatggctctcttcaaaacctgagttctgcatcaaagttctcaacccctacatgccgacagttatagaagagttggagaaactacagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccattgaaacagaaaaaccagacatgacaatcattgggagaaggcttcagagattgcaagaagagcacaaagaaacctggcactatgaccaggaaaatccatacagaacctgggcgtatcatggaagctatgaagctccttcgacaggctcagcatcctccatggtgaacggggtagtaaaactgctgacaaaaccttgggatgtgattccaatggtgacccagttggccatgacagacacaaccccttttgggcaacaaagagtgttcaaggagaaggtggataccagaacaccacaaccaaaacttggcacacgaatgattatgaccacgacagccaattggttgtgggccctcctcgggaagaagaaaagtcccagactgtgcacaagggaagagttcatctcaaaagttaggtcaaatgcagccataggcgcagtctttcaagaagaacagggatggacatcagccagtgaagctgtgaatgacagccggttctgggaactggttgacaaagaaagggctctgcaccaggaaggaaaatgtgaatcgtgtgtctataacatgatggggaaacgtgagaaaaaattaggagagtttggtagggccaagggaagccgagcaatctggtacatgtggctgggggcgcggttcctggaatttgaagccctgggttttttgaatgaagatcactggtttagcagagaaaactcatggagtggagtggaaggagaaggcctgcacagattgggatacatcttggaggacatagacaagaaggatggagacctgatatatgctgacgacacagcaggctgggacacgagaatcactgaggatgaccttttaaatgaagaactgatcacagaacagatggcccctcaccacaagaccctagccaaagccattttcaaactaacctatcaaaacaaagtggtgaaagtcctcagacccacaccgaaaggagcggtaatggacattatatccaggaaagaccaaagaggcagtggacaggttggaacatatggtttaaatacattcactaacatggaagttcaactcatccgccaaatggaagctgaaggagtcatcacacaagacgacatgcagaacccaaaagggttgaaagaaagagttgagaaatggctgaaagagtgtggcgtcgacaggttgaagaggatggcaatcagtggagatgattgcgtggtgaagcccctagatgagaggtttagcacctccctcctcttcttgaatgacatgggaaaggtgaggaaagacgtcccgcaatgggatccatccaagggatggaaaaactggcaagaggttcccttttgctcccaccattttcacaagatcttcatgaaagatggccgctcactggttgttccatgcagaaaccaggatgaactgataggaagagccagaatctcgcagggggctggatggagcttgagagaaacagcctgtctgggcaaagcttacgcccagatgtggtcgcttatgtacttccatagaagggacctgcgcctagcctccatggccatatgctcagcagttccaactgaatggtttccaacaagcagaacaacatggtcaatccatgctcaacaccagtggatgaccactgaagatatgcttaaagtgtggaacagagtgtggatagaagacaaccccaacatgactgacaagactccagtccattcgtgggaagacataccttacctagggaaaagagaggatctgtggtgtggatccctgattggactttcttccagagccacctgggcgaagaacattcacacggccataacccaggtcaggaatctgatcggaaaagaggaatacgtggattacatgccagtcatgaaaagatacagcgctccttccgagagtgaaggagttctgtaa

SEQ ID NO: 7866 - RNA, 9867 nt, synthetic construct
  misc_feature 1..9867: note = derived and/or modified CDS sequence (wt) from DENV-4__JQ915084__SS-prME
  source 1..9867: mol_type = other RNA
tcaacaatgacattgctgtgtttgattcccaccgtaatggcatttcacctgtcaacaagagacggcgaacccctcatgatagtggcaaaacacgaaagggggagacctctcttgttcaagacaacagaaggaatcaacaaatgcaccctcattgccatggacctgggtgaaatgtgtgaagacactgtcacgtataaatgccctctactggttaacaccgaacctgaagacatcgattgctggtgcaatctcacgtccacctgggtcatgtacgggacgtgcacccagagcggagaacggaggcgagagaagcgctcagtagctttaacaccacattcaggaatgggattggaaacaagagctgagacatggatgtcatcggaaggggcttggaaacatgctcagagagtggaaagctggatactcagaaacccaggattcgcgctcctggcaggatttatggcttacatgattgggcaaacaggaatccagcgaattgttttctttgtcctaatgatgctagtcgccccatcctacggaatgcgatgcgtaggggtagggaacagagacttcgtggaaggagtctcgggtggagcatgggtcgacctggtgctagaacatggaggatgcgtcacaaccatggcccagggaaaaccaaccctggattttgaactgaccaagacaacagctaaggaagtggctctgttgagaacctattgtattgaagcttcgatatcaaacataaccacagcaacaagatgtccaacgcaaggagagccttatctcaaagaggaacaagaccaacagtacatttgccggagagatgtggtagacagagggtggggcaatggctgtggcttgtttggaaaaggaggagttgtgacatgtgcgaagtttttatgctcggggaagattacaggcaatctggtccaaattgaaaaccttgaatacacggtagttgtgacagtccacaatggagacacccatgcagtaggaaatgacacatccaatcatggagtgacagccacgataactcccaggtcaccatcggtagaagttaaattgccggactatggagaactaacactcgactgtgaacccaggtctggaattgatttcaatgagatgatcctgatgaaaatgaaaaagaaaacgtggcttgtgcacaagcaatggtttttggacctacctctaccctggacagcaggagcagacacatcagaagttcattggaattacaaagagagaatggtgacattcaaggttcctcatgccaagagacaggatgtgacagtgctaggatctcaggagggagctatgcactctgccctcgccggagcaacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtatgaaggcgctggagctccgtgtaaaatccccatagagataagagatgtgaacaaggagaaagtagttgggcgcatcatctcatctaccccttttgctgagaataccaacagcgtaatcaacatagaattagaacccccttttggggacagctacatagtgataggtgttggagatagtgcattaacactccattggttcagaaaagggagctctattggcaagatgtttgagtccacatacagaggtgcaaaacgaatggccattctaggtgaaacagcttgggattttggttctgttggtggactgtttacatcactgggaaaggctgtacaccaagtttttggaagtgtgtatacaaccatgtttggaggggtctcatggatgatcagaatcctaattgggttcttagtattgtggattggcacgaattcaagaaatacttcaatggcaatgacgtgcatagctgttggaggaatcactctgtttttaggtttcacagttcaagcagacatgggttgtgtggtgtcatggaatgggaaggaactaaaatgtggaagcggaatttttgtggttgacaacgtgcacacttggacagaacagtacaaattccaaccagagtccccagcgaggctagcgtctgcaatactgaatgcccacaaagatggggtctgtggaatcagatcaaccacgaggctggaaaatgttatgtggaagcaaataaccaacgagctaaactatgttctctgggaaggaggacatgacctcactgtagtggctggggacgtaaagggggtgttgaccaaaggcaagagagcactcacacctccagtgaatgatctgaaatattcatggaagacgtggggaaaagcaaaaatctttaccccagaagcaagaaatagcacatttttaatagacggaccagacacctccgaatgccccaatgaacgaagagcatggaacttttttgaggtagaagactatggatttggcatgttcacgaccaacatatggatgaaattccgagaaggaagttcagaagtgtgtgaccatagattaatgtcggcggcaatcaaagatcagaaagctgtgcatgccgacatgggttattggatagagagctcaaaaaaccagacctggcagatagagaaagcatccctcattgaagtgaaaacatgtctgtggcccaaaacccacacactgtggagcaatggggtgctggaaagtcagatgctcattccaagatcatatgcaggccctttttcacagcacaattaccgccagggctatgccacgcaaaccgcgggcccatggcacttaggcaaattggagatagactttggagaatgccccggaacaacagttaaaattcaggaagattgtgaccatagaggcccatctttgaggaccaccactgcatctgggaaactggttacgcaatggtgctgccgctcctgcacgatgcctcccttaaggttcttgggggaagacggatgttggtatgggatggagattaggcccttgagtgaaaaagaagagaacatggtcaaatcacaggtaacagccggacagggtacatcagaaactttttctatggggctgctatgcctgaccttgttcgtggaagaatgcttgaggagaagagtcactaggaaacacatgatattggttgtggtaatcaccttctgtgctatcatcttaggaggtctcacatggatggacttactgcgagcccttatcatgttaggggacactatgtctggtagaataggaggacagattcacctagccatcatgacagtgttcaagatgtcaccaggatatgtgctgggtgtgtttttaaggaaacttacttcaagagagacagcgctaatggtaataggaatggccatgacaacggtgttttcaattccacatgacctcatggaactcattgatggaatatcattggggctgatattactaaaaatagtaacacactttgataacacccaagtgggaaccttagccctttccctgactttcatgagatcaacaacaccattagtcatggcttggaggaccatcatggctgtgttctttgtgatcacacttattcctttgtgcaggacaagctgtcttcaaaaacagtcccattgggtagaaataacagcacttatcttaggagcccaggctttgccagtgtacctaatgactctcatgaaaggagcctcaagaagatcttggcctcttaatgagggtataatggctgtgggtttggtgagcctcttaggaagcgccctcctaaagaatgatgttcctttagctggcccaatggtagcaggaggcttacttctagcggcttacgtaatgagtggcagctcagcagacctgtcactagagaaggctgccaatgtacagtgggatgaaatggcggacataactggctcaagcccaatcatagaagtgaagcaggatgaagatggctctttctccatacgggacgtcgaggaaaccaacatgataaccctcttggtgaaactggcgctgataacagtatcaggtctttaccccttggcaattccagtcacaatggcactatggtatatttggcaagtgaaaacacaaagatcaggagctctgtgggacgtcccctcgcccgctgccactcagaaagccacactgtctgaaggggtgtataggatcatgcaaagagggctgtttgggaaaactcaggttggagtagggatacacatggaaggtgtattccacacaatgtggcacgtgacaagaggatcagtgatctgccatgagacagggagattagagccatcttgggctgacgtcaggaatgacatgatatcatacggtgggggatggaggctcggagacaaatgggataaagaagaagatgttcaggtcctggccatagaaccaggaaaaaatcctagacatgtccaaacgaaaccaggccttttcaagaccctaactggagaaattggagcagtaactctggatttcaaacctggaacgtctggctctcctatcatcaacaagaaagggaaagttattggactctatggaaatggagtagttaccaaatcaggtgattacgtcagtgccataacgcaagccgaaagaattggtgagccagattatgaagtagatgaggacatttttcgaaagaaaagattaactataatggacttacaccccggagctggaaagacaaaaagaattctcccatcaatagtcagagaagctttgaaaaggaggctgcgaaccttgattttggctcccacgagagtggtggcggccgagatggaagaggccctacgcggactgccaatccgctatcagaccccagctgtgaaatcagagcacacaggaagagagattgttgacctcatgtgccatgcaaccttcacaacgagacttttgtcatcaaccagggttccaaattacaaccttatagtgatggatgaagcacattttactgacccttgtagtgtcgcggctagaggatacatctcaaccagggtggaaatgggagaggcagcagctatcttcatgactgcaacccctcctggatcgatagatcccttcccccagagcaacagcccaatagaagacatcgagagggaaatccccgaaaggtcatggaacacagggttcgactggataacagactaccaaggaaaaactgtgtggtttgttcccagcataaaagccggaaatgacatcgcaaattgtttgagaaagtcgggaaagagagtgatccagttgagcagaaaaacctttgacacagagtatccaaagacgaaactcacggactgggattttgtggtcaccacagacatatctgaaatgggggccaattttagagctgggagagtgatagaccccaggagatgcctcaagccagttatcctaacagatgggccagagagagttattctagcaggtccaatcccagtaactccagcaagtgccgctcagagaagagggcgaataggtaggaatccagcacaagaagatgaccaatatgttttctccggagacccactaaagaatgatgaagatcatgctcactggacagaagcaaagatgttgcttgacaatatctacacccctgaagggataattccaacattgtttggtccggaaagggaaaaaacccaagccattgatggagagtttcgcctcagaggggaacaaaggaagactttcgtggaattgatgaggagaggagaccttccggtgtggctgagctacaaggtagcttctgccggtatctcttacaaagaccgagaatggtgcttcacaggagaaaggaataaccaaattttagaagaaaacatggaggttgaaatctggactagagagggagaaaagaaaaagctaaggccaaaatggttagatgcacgtgtgtacgctgaccccatggctttgaaggatttcaaggagttcgccagtggaagaaagagcacaactcttgacatcctaacagagatcgccactttgccaacctacctttcctctaaggccaaactagcccttgacaacatagtcatgctccacacaacagaaaaaggagggagggcctaccaacacgccctgaacgaactcccggagtcactggaaacactcatgctcgtagccctactaggtgctatgacagccggtatcttcctgttttttatgcaggggaaaggaatagggaaattgtcaatgggtctgatagctatagctgtggccagtggcttgctctgggtagcggaaattcagccccagtggatagcagcttcaatcatactggagttttttcttatggtgctgttgataccagaaccagaaaaacaaaggaccccacaagacaatcaattgatctacgttatattgactattctcgccattattggtctcatagcagccaatgagatggggctgattgaaaaaacaaaaacggactttgggttctaccaggtaaaaacagaaaccaccattcttgatgtggatttgagaccagcctcagcatggacactctatgcagtggccaccacaattctgactcccatgctgagacacaccatagagaacacgtctgccaacttatctctagcagccattgccaaccaggcagctgtcctaatgggacttggaaaaggatggccgctccacagaatggacctcggtgtgccgctgttagccatgggatgttattcccaagtgaacccaacaaccctgacagcatccctagtcatgcttttaatccattatgccataataggtccaggattgcaggcaaaagccacaagagaggcccagaaaaggacagctgctgggatcatgaagaaccccacggtggacgggataacagtaatagatttagaaccaatatcctatgacccaaaatttgaaaagcagttagggcaagtcatgctactagtcctgtgtgttggacaattacttttgatgagaacaacctgggctctctgcgaagtattaactttggccacaggaccaatcatgaccttgtgggagggcaacccgggaaggttttggaacacgaccatagctgtatccacagccaacatttttagaggaagctacctggcgggggctggactagctttttcgctcataaagaatgcacaaacccctaggaggggaactgggaccacaggagagacactgggagagaagtggaagagacagctaaactcattagacagaaaagagtttgaagagtacaaaagaagtggaatattagaagtggataggactgaggccaagtctgccctaagagatggatctaaaatcaagcatgcggtgtctagagggtctagtaagatcagatggattgttgaaagagggatgataaagccaaaaggaaaggtcgtggatcttggttgcgggaggggaggatggtcctattacatggcgacactcaagaacgtgactgaagtgaaagggtacacaaaaggaggcccaggacatgaagaaccaattcctatggctacttatggctggaatttggtcaaactccattcaggggttgatgtgttctacaaacccactgagcaggtggacaccctgctctgtgacattggggagtcatcctccaatccaacaatagaggaaggaagaacattgagaatcttgaagatggtggagccatggctctcttcaaaacctgagttctgcatcaaagtcctcaacccctacatgccgacagttatagaagagttggagaaactgcagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacaatcattgggagaaggcttcagagattgcaagaagagcacaaggaaacctggcactatgaccaggaaaatccatacagaacctgggcgtatcatggaagctacgaagctccttcgacaggctcagcatcctccatggtgaacggggtggtaaaactgctgacaaaaccttgggatgtgattccaatggtgacccagttggccatgacagacacaaccccttttgggcaacaaagagtgttcaaggagaaggtggataccagaacaccacaaccaaaaattggcacacgaatgattatgaccacgacagccaattggttgtgggccctcctcgggaagaagaaaagtcccagactgtgcacaagggaagagttcatctcaaaagttaggtcaaatgcagccataggcgcagtctttcaagaagaacagggatggacatcagccagtgaagctgtgaatgacagccggttctgggaactggttgacaaagaaagggctctgcaccaggaaggaaaatgtgaatcgtgtgtttataacatgatggggaaacgtgagaaaaaattaggagagtttggtagggccaagggaagccgagcaatctggtacatgtggctgggggcgcggttcctggaatttgaagccctgggttttttgaatgaagatcactggtttagcagagaaaactcatggagtggagtggaaggagaaggcctgcacagattgggatacatcttggaggacatagacaagaaggatggagacctgatatatgctgacgacacagcaggctgggacacgagaatcactgaggatgaccttttaaatgaagaactgatcacagaacagatggcccctcaccacaagaccctagccaaagccattttcaaactaacctatcaaaacaaagtggtgaaagtcctcagacccacaccgaaaggagcggtaatggacattatatccaggaaagaccaaagaggcagtggacaggttggaacatatggtttaaatacattcactaacatggaagttcaactcatccgccaaatggaagctgaaggagtcatcacacaagacgacatgcagaacccaaaagggttgaaagaaagagttgagaaatggctgaaagagtgtggcgtcgacaggttgaagaggatggcaatcagtggagatgattgcgtggtgaagcccctagatgagaggttcagcacctccctcctcttcttgaatgacatgggaaaggtgaggaaagacgtcccgcaatgggaaccatccaagggatggaaaaactggcaagaggttcccttttgctcccaccattttcacaagatcttcatgaaagatggccgctcactggttgttccatgcagaaaccaggatgaactgataggaagagccagaatctcgcagggggctggatggagcttgagagaaacagcctgtctgggcaaagcttacgcccagatgtggtcgcttatgtacttccatagaagggacctgcgcctagcctccatggccatatgctcagcagttccaactgaatggtttccaacaagcagaacaacatggtcaatccatgctcaacatcagtggatgaccactgaagatatgcttaaagtgtggaacagagtgtggatagaagacaaccccaatatgactgacaagactccagtccattcgtgggaagacataccttacctagggaaaagagaggatctgtggtgtggatccctgattggactttcttccagagccacctgggcgaagaacattcacacggccataacccaggtcaggaatctgatcggaaaagaggaatacgtggattacatgccagtcatgaaaagatacagctctccttccgagagtgaaggagttctgtaa

SEQ ID NO: 7867 - RNA, 9867 nt, synthetic construct
  misc_feature 1..9867: note = derived and/or modified CDS sequence (wt) from DENV-4__KM190936__SS-prME
  source 1..9867: mol_type = other RNA
tcaacgataacattgctgtgcttgattcccaccgtaatggcgttttccttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccatgataactcccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggaaggaggacatgacctcactgtagtggctggggatgtgaagggggtgttgaccaaaggcaagagagcactcacacccccagtgagtgatctgaaatattcatggaagacatggggaaaagcaaaaatcttcaccccagaagcaagaaatagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcacaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttagctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaagaaataaccaaattttagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgataacatagtcatgctccacacaacagaaagaggagggagggcctatcaacacgccctgaacgaacttccggagtcactggaaacactcatgcttgtagctttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccggaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggttggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctatgaagctccttcgacaggctctgcatcctccatggtgaacggggtagtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggagctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 7868 - RNA, 9867 nt, synthetic construct
  misc_feature 1..9867: note = derived and/or modified CDS sequence (wt) from DENV-4__JQ915090__SS-prME
  source 1..9867: mol_type = other RNA
tcaacaatgacattgctgtgtttgattcccaccgtaatggcatttcacctgtcaacaagagacggcgaacccctcatgatagtggcaaaacacgaaagggggagacctctcttgttcaagacaacagaaggaatcaacaaatgcaccctcattgccatggacctgggtgaaatgtgtgaagacactgtcacgtataaatgccctctactggttaacaccgaacctgaagacatcgattgctggtgcaatctcacgtccacctgggtcatgtacgggacgtgcacccagagcggagaacggaggcgagagaagcgctcagtagctttaacaccacattcaggaatgggattggaaacaagagctgagacatggatgtcatcggaaggggcttggaaacatgctcagagagtggaaagctggatactcagaaacccaggattcgcgctcctggcaggatttatggcttacatgattgggcaaacaggaatccagcgaattgttttctttgtcctaatgatgctagtcgccccatcctacggaatgcgatgcgtaggggtagggaacagagacttcgtggaaggagtctcgggtggagcatgggtcgacttggtgctagaacatggaggatgcgtcacaaccatggcccagggaaaaccaaccctggattttgaactggccaagacaacagctaaggaagtggctctgttgagaacctattgtattgaagcttcgatatcaaacataaccacagcaacaagatgtccaacgcaaggagagccttatctcaaagaggaacaagaccaacagtacatttgccggagagacgtggtagacagagggtggggcaatggctgtggcttgtttggaaaaggaggagttgtgacatgtgcgaagtttttatgctcggggaagattacaggtaatctggtccaaattgaaaaccttgaatacacggtagttgtgacagtccacaatggagacacccatgcagtaggaaatgacacatccaatcatggagtgacagccacgataactcccaggtcaccatcggtagaagttaaattgccggactatggagaactaacactcgactgtgaacccaggtctggaattgatttcaatgagatgatcctgatgaaaatgaaaaagaaaacgtggcttgtgcacaagcaatggtttttggacctacctctaccttggacagcaggagcagacacatcagaagttcattggaattacaaagagagaatggtgacattcaaggttcctcatgccaagagacaggatgtgacagtgctaggatctcaggagggagctatgcactctgccctcgccggggcaacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaagtatgaaggcgctggagctccgtgtaaaatccccatagagataagagatgtgaacaaggagaaagtagttgggcgcatcatctcatctaccccttttgctgagaataccaacagcgtaatcaacatagaattagaacccccttttggggacagctacatagtgataggtgttggagatagtgcattaacactccattggttcagaaaagggagctctattggcaagatgttcgagtccacatacagaggtgcaaaacgaatggccattctaggtgaaacagcttgggattttggttctgttggtggactgtttacatcactgggaaaggctgtacaccaagtttttggaagtgtgtatacaaccatgtttggaggggtctcatggatgattagaatcctaattgggttcttagtattgtggattggcacgaattcaagaaatacttcaatggcaatgacgtgcatagctgttggaggaatcactctgtttctaggtttcacagttcaagcagacatgggttgtgtggtgtcatggaatgggaaggaactaaaatgtggaagcggaatttttgtggttgacaacgtgcacacttggacagaacagtacaaattccaaccagagtccccagcgaggctagcgtctgcaatactgaatgcccacaaagatggggtctgtggaatcagatcaaccacgaggctggaaaatgttatgtggaagcaaataaccaacgagctaaactatgttctctgggaaggaggacatgacctcactgtagtggctggggacgtaaagggggtgttgaccaaaggcaagagagcactcacacctccagtgaatgatctgaaatattcatggaagacgtggggaaaagcaaaaatctttaccccagaagcaagaaatagcacatttttaatagacggaccagacacctccgaatgccccaatgaacgaagagcatggaacttttttgaggtagaagactatggatttggcatgttcacgaccaacatatggatgaaattccgagaaggaagttcagaagtgtgtgaccatagattaatgtcggcggcaatcaaagatcagaaagctgtgcatgccgacatgggttattggatagagagctcaaaaaaccagacctggcagatagagaaagcatccctcattgaagtgaaaacatgtctgtggcccaaaacccacacactgtggagcaatggggtgctggaaagtcagatgctcattccaagatcatatgcaggccctttttcacagcacaattaccgccagggctatgccacgcaaaccgcgggcccatggcacttaggcaaattggagatagactttggagaatgccccggaacaacagttaaaattcaggaagattgtgaccatagaggcccatctttgaggaccaccactgcatctggaaaactggttacgcaatggtgctgccgctcctgcacgatgcctcccttaaggttcttgggggaagacggatgttggtatgggatggagattaggcccttgagtgaaaaagaagagaacatggtcaaatcacaggtaacagccggacagggtacatcagaaactttttctatggggctgctatgcctgaccttgttcgtggaagaatgcttgaggagaagagtcactaggaaacacatgatattggttgtggtaatcaccttctgtgctatcatcttaggaggtctcacatggatggacttactgcgagcccttatcatgttaggggacactatgtctggtagaataggaggacagattcacctagccatcatgacagtgttcaagatgtcaccaggatatgtgctgggtgtgtttttaaggaaacttacttcaagagagacagcgctaatggtaataggaatggccatgacaacggtgttttcaattccacatgacctcatggaactcattgatggaatatcattggggctgatattactaaaaatagtgacacactttgataacacccaagtgggaaccttagccctttccctgactttcatgagatcaacaacaccattagtcatggcttggaggaccatcatggctgtgttctttgtgatcacacttattcctttgtgcaggacaagctgtcttcaaaaacagtcccattgggtagaaatgacagcacttatcttaggagcccaggctttgccagtgtacctaatgactctcatgaaaggagcctcaagaagatcttggcctcttaatgagggtataatggctgtgggtttggtgagcctcttaggaagcgccctcctaaagaatgatgttcctttagctggcccaatggtagcaggaggcttacttctagcggcttacgtaatgagtggcagctcagcagacctgtcactagagaaggctgccaatgtacagtgggatgaaatggcggacataactggctcaagcccaatcatagaagtgaaacaggatgaagatggctctttctccatacgggacgtcgaggaaaccaacatgataaccctcttggtgaaactggcgctgataacagtatcaggtctttaccccttggcaattccagtcacaatggcactatggtatatttggcaagtgaaaacacaaagatcaggagctctgtgggacgtcccctcgcccgctgccactcagaaagccacactgtctgaaggggtgtataggatcatgcaaagagggctgtttgggaaaactcaggttggagtagggatacacatggaaggtgtattccacacaatgtggcacgtgacaagaggatcagtgatctgccatgagacagggagattagaaccatcttgggctgacgtcaggagtgacatgatatcatacggtgggggatggaggctcggagacaaatgggataaagaagaagatgttcaggtcctggccatagaaccaggaaaaaatcctagacatgtccaaacgaaaccaggccttttcaagaccctaactggagaaattggagcagtaactctggatttcaaacctggaacgtctggctctcctatcatcaacaagaaagggaaagttattggactctatggaaatggagtagttaccaaatcaggtgattacgtcagtgccataacgcaagccgaaagaattggtgagccagattatgaagtagatgaggacatttttcgaaagaaaagattaactataatggacttacaccccggagctggaaagacaaaaagaattctcccatcaatagtcagagaagctttgaaaaggaggctgcgaaccttgattttggctcccacgagagtggtggcggccgagatggaagaggccctacgcggactgccaatccgctatcagaccccagctgtgaaatcagagcacacaggaagagagattgtagacctcatgtgccatgcaaccttcacaacgagacttttgtcatcaaccagggttccaaattacaaccttatagtgatggatgaagcacattttactgacccttgtagtgtcgcggctagaggatacatctcaaccagggtggaaatgggagaggcagcagctatcttcatgactgcaacccctcctggatcgatagatcccttcccccagagcaacagcccaatagaagacatcgagagggaaatccccgaaaggtcatggaacacagggttcgactggataacagactaccaaggaaaaactgtgtggtttgttcccagcataaaagccggaaatgacatcgcaaattgtttgagaaagtcgggaaagagagtgatccagttgagcagaaaaacctttgacacagagtatccaaagacgaaactcacggactgggattttgtggtcaccacagacatatctgaaatgggggccaattttagagctgggagagtgatagaccccaggagatgcctcaagccagttatcctaacagatgggccagagagagttattctagcaggtccaatcccagtaactccagcaagtgccgctcagagaagagggcgaataggtaggaatccagcacaagaagatgaccaatatgttttctccggagacccactaaagaatgatgaagatcatgctcactggacagaagcaaagatgttgcttgacaatatctacacccctgaagggataattccaacattgtttggtccggaaagggaaaaaacccaagccattgatggagagtttcgcctcagaggggaacaaaggaagactttcgtggaattgatgaggagaggagaccttccggtgtggctgagctacaaggtagcttctgccggtatctcttacaaagaccgagaatggtgcttcacaggagaaaggaataaccaaattttagaagaaaacatggaggttgaaatctggactagagagggagaaaagaaaaagctaaggccaaaatggttagatgcacgtgtgtacgctgaccccatggctttgaaggatttcaaggagttcgccagtggaagaaagagcacaactcttgacatcctaacagagattgccactttgccaacctacctttcctctaaggccaaactagcccttgacaacatagtcatgctccacacaacagaaaaaggagggagggcctaccaacacgccctgaacgaactcccggagtcactggaaacactcatgctcgtagccctactaggtgctatgacagccggtatcttcctgttttttatgcaggggaaaggaatagggaaattgtcaatgggtctgatagctatagctgtggccagtggcttgctctgggtagcggaaattcagccccagtggatagcagcttcaatcatactggagttttttcttatggtgctgttgataccagaaccagaaaaacaaaggaccccacaagacaatcaattgatctacgttatattgactattctcaccattattggtctcatagcagccaatgagatggggctgattgaaaaaacaaaaacggactttgggttctaccaggtaaaaacagaaaccaccattcttgatgtggatttgagaccagcctcagcatggacactctatgcagtggccaccactattctgactcccatgctgagacacaccatagagaacatgtctgccaacttatctctagcagccattgccaaccaggcagctgtcctaatgggacttggaaaaggatggccgctccacagaatggacctcggtgtgccgctgttagccatgggatgttattcccaagtgaacccaacaaccctgacagcatccctagtcatgcttttaatccattatgccataataggtccaggattgcaggcaaaagccacaagagaggcccagaaaaggacagctgctgggatcatgaagaaccccacggtggacgggataacagtaatagatttagaaccaatatcctatgacccaaaatttgaaaagcagttagggcaagtcatgctactagtcctgtgtgttggacaattacttttgatgagaacaacctgggctctctgcgaagtattaactttggccacaggaccaatcatgaccttgtgggagggcaacccgggaaggttttggaacacgaccatagctgtatccacagccaacatttttagaggaagctacctggcgggggctggactagctttttcgctcataaagaatgcacaaacccctaggaggggaactgggaccacaggagagacactgggagagaagtggaagagacagctaaactcattagacagaaaagagtttgaagagtacaaaagaagtggaatattagaagtggataggactgaggccaagtctgccctaagagatggatctaaaatcaagcatgcggtgtccagagggtctagtaagatcagatggattgttgaaagagggatgataaagccaaaaggaaaggtcgtggatcttggttgcgggaggggaggatggtcctattacatggcgacactcaagaacgtgactgaagtgaaagggtatacaaaaggaggcccaggacatgaagaaccaattcccatggctacttatggctggaatttggtcaaactccattcaggggttgatgtgttctacaaacccactgagcaggtggacaccctgctctgtgacattggggagtcatcctccaatccaacaatagaggaaggaagaacattgagaatcttgaagatggtggagccatggctctcttcaaaacctgagttctgcatcaaagtcctcaacccctacatgccgacagttatagaagagttggagaaactgcagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacaattattgggagaaggcttcagagattgcaagaagagcacaaagaaacctggcactatgaccaggaaaatccatacagaacctgggcgtatcatggaagctatgaagctccttcgacaggctcagcatcctccatggtgaacggggtagtaaaactgctgacaaaaccttgggatgtgattccaatggtgacccagttggccatgacagacacaaccccttttgggcaacaaagagtgttcaaggagaaggtggataccagaacaccacaaccaaaacttggcacacgaatgattatgaccacgacagccaattggttgtgggccctcctcgggaagaagaaaagtcccagactgtgcacaagggaagagttcatctcaaaagttaggtcaaatgcagccataggcgcagtctttcaagaagaacagggatggacatcagccattgaagctgtgaatgacagccggttctgggaactggttgacaaagaaagggctctgcaccaggaaggaaaatgtgaatcgtgtgtttataacatgatggggaaacgtgagaaaaaattaggagagtttggtagggccaagggaagccgagcaatctggtacatgtggctgggggcgcggttcctggaatttgaagccctgggttttctgaatgaagatcactggtttagcagagaaaactcatggagtggagtggaaggagaaggcctgcacagattgggatacatcttggaggacatagacaagaaggatggagacctgatatatgctgacgacacagcaggctgggacacgagaatcactgaggatgaccttttaaatgaagaactgatcacagaacagatggcccctcaccacaagaccctagccaaagccattttcaaactaacctatcaaaacaaagtggtgaaagtcctcagacccacaccgaaaggagcggtaatggacattatatccaggaaagaccaaagaggcagtggacaggttggaacatatggtttaaatacattcactaacatggaagttcaactcatccgccaaatggaagctgaaggagtcatcacacaagacgacatgcagaacccaaaagggttgaaagaaagagttgagaaatggctgaaagagtgtggcgtcgacaggttgaagaggatggctatcagtggagatgattgcgtggtgaagcccctagatgagaggtttagcacctccctcctcttcttgaatgacatgggaaaggtgaggaaagacgtcccgcaatgggaaccatccaagggatggaaaaactggcaagaggttcccttttgctcccaccattttcacaagatcttcatgaaagatggccgctcactggttgttccatgcagaaaccaggatgaactgataggaagagccagaatctcgcagggggctggatggagcttgagagaaacagcctgtctgggcaaagcttacgcccagatgtggtcgcttatgtacttccatagaagggacctgcgcctagcctccatggccatatgctcagcagttccaactgaatggtttccaacaagcagaacaacatggtcaatccatgctcaacatcagtggatgaccactgaagatatgcttaaagtgtggaacagagtgtggatagaagacaaccccaatatgactgacaagactccagtccattcgtgggaagacataccttacctagggaaaagagaggatctgtggtgtggatccctgattggactttcttccagagccacctgggcgaagaacattcacacggccataacccaggtcaggaatctgatcggaaaagaggaatacgtggattacatgccagtcatgaaaagatacagctctccttccgagagtgaaggagttctgtaa

SEQ ID NO: 7869 - RNA, 9867 nt, synthetic construct
  misc_feature 1..9867: note = derived and/or modified CDS sequence (wt) from DENV-4__KJ160504__SS-prME
  source 1..9867: mol_type = other RNA
tcaacgataacattgctgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctgatgatgctggtcgccccatcctacggaatgcgatgcgtaggagtgggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccgtatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatctggtccaaattgagaaccttgagtacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgatcctaatgaaaatgaaaaagaaaacatggctcgtgcacaagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagctccattggcaagatgtttgagtccacatacagaggtgcaaaacgaatggccattctgggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggaggaatcactctgtttctgggcttcacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggacgtgaagggagtgttgaccaaaggcaagagagcactcacacccccagtgagtgatctgaaatattcatggaagacatggggaaaagcaaaaatcttcaccccagaagcaagaaacagcacatttttgatagatggaccagacacctctgaatgccccaatgaacgaagagcatggaactctcttgaggtggaagattatggatttggcatgttcacgacgaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacccaaacagtgggcccatggcacttaggcaaattagagatagactttggagaatgccccggaacaacagtcacaattcaggaggattgtgaccatagaggcccatctttgaggaccaccactgcatctggaaaactagtcacgcaatggtgttgccgctcctgcacgatgcctcccttaaggttcttgggagaagatgggtgctggtatgggatggagattaggcccttgagtgaaaaagaagagaacatggtcaaatcacaggtgacggccggacagggcacgtcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacctactacgagccctcatcatgttgggggacactatgtctggtagaataggaggacagatccacctagccatcatggcagtgttcaagatgtcaccaggatacgtgctgggtgtgttcttaaggaaactcacttcaagagagacagcactaatggtaataggaatggccatgacaacggtactttcaattccacatgaccttatggaactcattgatggaatatcactaggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttagggagcgctcttttaaagaatgatgtccctttggctggcccaatggtggcaggaggcttacttctggcggcttacgtgatgagtggcagctcagcagatctgtcactagagaaggccgccaatgtgcagtgggatgaaatggcagacataacaggctcaagcccaatcatagaagtgaagcaagatgaagatggctctttctccatacgggacgtcgaggaaaccaatatgataacccttttggtgaaactggcactgataacagtgtcaggtctctaccccttggcaattccaatcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcatacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattggatttcaaacccggaacgtctggttctcccatcatcaacaggaaaggaaaagtcatcggactctatggaaatggagtagttaccaaatcaggtgactacgtcagtgccataacgcaagccgaaagaattggagagccagattatgaagtggatgaggatatttttcgaaagaaaagattaactataatggacttacaccccggagctggaaagacaaaaagaattcttccatcaatagtgagagaagccttaaaaaggaggctgcgaactttgattttagctcccacgagagtggtggcggccgagatggaagaggccctacgtggactgccaatccgttatcagaccccagctgtgaaatcagaacacacaggaagagagattgtagacctcatgtgtcacgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaaccccaccaggtgcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagtcatccagttgagcaggaaaacctttggtacagagtatccaaaaacgaaactcacggactgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgagtaggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaagaaataaccaaattttagaagaaaacatggaggttgaaatttggactagagagggagaaaagaaaaaattgaggccaagatggttagatgcacgtgtatacgctgaccccatggctttgaaggatttcaaggagtttgccagtggaaggaagagtataactctagacatcctaacagagattgccagtttgccagcatacctttcctctagggccaagctcgcccttgataacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctggatagcagaaattcaaccccagtggatagcggcctcaatcatactagagttttttctcatggtactgttgataccagaaccagaaaaacaaaggaccccacaagacaatcaattgatctatgtcatattgaccgttctcaccatcattggtctgatagcagccaacgagatggggctgattgaaaaaacaaaaacggactttgggttctaccaggtaaaaacagaaaccaccatcctcgatgtggacttgagaccagcttcagcatggacgctctatgcagtagccaccacagttttgactcccatgctgagacacaccatagaaaacacgtcggccaacctatctctagcagccatcgccaaccaggcagccgtcctaatggggcttggaaagggatggccgctacacagaatggacctcggtgtgccgctgttagcaatgggatgctattctcaagtgaacccaacaaccttgacagcatccttagtcatgctttttgtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcctgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaactcctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtttctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttttacaaacccacagagcaagtggacaccctgctctgtgatattggggagtcatcttctaatccaacaatagaggagggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccacaaccaaaaccaggcacacgaatggttatgaccacgacagccaattggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgactccagattttgggaactggttgacaaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggcttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggggatgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagtcccaacggaatggtttccaacaagcagaacaacatggtcaatccacgctcatcaccagtggatgaccactgaagacatgctcaaagtgtggaacagagtgtggatagaagacaaccctaatatgactgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7870 - RNA, 9867 nt, synthetic construct
  misc_feature 1..9867: note = derived and/or modified CDS sequence (wt) from DENV-4__GU289913__SS-prME
  source 1..9867: mol_type = other RNA
tcaacgataacattgctgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggttgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgatacatccaatcatggagttacagccatgataactcccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggaaggaggacatgacctcactgtagtggctggggatgtgaagggggtgttgaccaaaggcaagagagcactcacacccccagtgagtgatctgaaatattcatggaagacatggggaaaagcaaaaatcttcaccccagaagcaagaaacagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcacaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaagaaataaccaaatattagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgataacatagtcatgctccacacaacagaaagaggagggagggcctatcaacacgccctgaacgaacttccggagtcactggaaacactcatgcttgtagctttactaggtgctatgacagcaggtattttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccagaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctttatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgctttcagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggacctatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcctattacatggcgacactcaagaacgtgactgaagtgaaagggtatacaaaaggaggtccaggacatgaagaaccgattcccatggctacttatggctggaatttggtcaaacttcattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctatgaagctccttcgacaggctctgcatcctccatggtgaacggggtagtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaattactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggcttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatttgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcaggaacctgatcggaaaagaggaatacgtggattacatgccagtaatgaaaagatacagtgctccttcagagagtgagggagttctgtaa

SEQ ID NO: 7871 - RNA, 9867 nt, synthetic construct
  misc_feature 1..9867: note = derived and/or modified CDS sequence (wt) from DENV-4__KJ579243__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaaccatggggttacagccacgataactcccaggtcaccatcggttgaagtcaaactgccggactatggagaactaacacttgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggagaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggtgcttagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcggtctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagaaagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatattgggggacactatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcctggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcagagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattctggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtggaaatgggagaggcagcagccatcttcatgaccgcaacccctcccggagcgacggatccatttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctgacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactgggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggacctcggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagattagatggatcgtagagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagaaaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7872 - RNA, 9867 nt, synthetic construct
  misc_feature 1..9867: note = derived and/or modified CDS sequence (wt) from DENV-4__KJ579246__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaaccatggggttacagccacgataactcccaggtcaccatcggttgaagtcaaactgccggactatggagaactaacacttgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggagaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagaaagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatattgggggacactatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattctggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtggaaatgggagaggcagcagccatcttcatgaccgcaacccctcccggagcgacggatccatttccccagagcaacagcccaatagaagacatcgagagagagattccggaaaggtcatggaacacagggttcgactggataacagactaccaagggaaaactgtgtggtttgttcctagcataaaagctggaaatgacattgcaaactgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctgacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggacctcggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagattagatggatcgtagagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagaaaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacgcaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccaatccattcgtgggaagatataccttacctagggaaaagagaggatttgtggtgtggatccctgattggactttcttctagagccacctgggcgaagaacattcacacggccataactcaggtcaggaatctgattggaaaagaggaatacgtggattatatgccagtaatgaaaagatacagtgctccttcagagagtgaaggagttctgtaa

SEQ ID NO: 7873 - RNA, 9867 nt, synthetic construct
  misc_feature 1..9867: note = derived and/or modified CDS sequence (wt) from DENV-4__KJ579248__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggggttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaacaccaatagtgtaaccaacatagaattagaacccccctttggggacagctacatagtgataggtgttggaaacagcgcactaacactccattggtttaggaaagggagttccattggtaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtggtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttctctatgggtctgttgtgcctgaccttgtttgtggaagaatgcttgagaagaagagtcaccaggaaacacatgatattagctgtggtaatcactctttgtgctatcatcctggggggcctcacatggatggacttgctacgagccctcatcatgttgggggacactatgtctggcagagtaggaggacagacccacctagccatcatagcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtagaaatgggagaggcagcagccatcttcatgaccgcaacccctcccggagcgacggatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttaaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggaccttggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactagtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggaccgaagccaagtccgccctgaaagatgggtccaaaatcaagcatgcagtatctagagggtccagtaagattagatggatcgttgagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccaattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaatagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacatccacacggccataactcaggtcaggaatctgatcggaaaagaggaatacgtggattatatgtcagtaatgaaaagatacagtgctccttcagagagtgaaggagttctgtaa

SEQ ID NO: 7874 - RNA, 9867 nt, synthetic construct
  misc_feature 1..9867: note = derived and/or modified CDS sequence (wt) from DENV-4__KJ579240__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgtacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggggttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggtaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggccgtgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtggtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttctctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatgttgggggacactatgtctggcagaataggaggacagacccacctagccatcatagcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggctgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtagaaatgggagaggcagcagccatcttcatgaccgcaacccctcccggagcgacggatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttaaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaatgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggaccttggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactagtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggaccgaagccaagtccgccctgaaagatgggtccaaaatcaagcatgcagtatctagagggtccagtaagattagatggatcgttgagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaatagaaaaaccagacatgacaatcattgggagaaggcttcagcgattgcaagaagagcacaaagaaacatggcattatgatcaagaaaacccatacagaacctgggcgtaccatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtacatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgtcagtaatgaaaagatacagtgctccttcagagagtgaaggagttctgtaa

SEQ ID NO: 7875 - RNA, 9867 nt, synthetic construct
  misc_feature 1..9867: note = derived and/or modified CDS sequence (wt) from DENV-4__KJ596658__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaaccatggggttacagccacgataactcccaggtcaccatcggttgaagtcaaactgccggactatggagaactaacacttgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggagaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagaaagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatattgggggacactatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcctggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtggggttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattctggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtggaaatgggagaggcagcagccatcttcatgaccgcaacccctcccggagcgacggatccatttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctgacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactgggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggacctcggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgctactcgtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagattagatggatcgtagagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacatcgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagaaaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7876 - RNA, 9867 nt, synthetic construct
  misc_feature 1..9867: note = derived and/or modified CDS sequence (wt) from DENV-4__KJ596659__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttcttcgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaaccatggggttacagccacgataactcccaggtcaccatcggttgaagtcaaactgccggactatggagaactaacacttgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaatcacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttctcaattgacaaagagatggcagaaacacagcatgggacaacagtggtgaaagtcaagtatgaaggtgctggagctccgtgcaaagtccccatagagataagagatgtaaacaaggagaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagaaagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatattgggggacactatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcctggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattctggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtggaaatgggagaggcagcagccatcttcatgaccgcaacccctcccggagcgacggatccatttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggacttcgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctgacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggacctcggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagattagatggatcgtagagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgttgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagaaaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7877 - RNA, 9867 nt, synthetic construct
  misc_feature 1..9867: note = derived and/or modified CDS sequence (wt) from DENV-4__KJ596661__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaataaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacacctcattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgtcgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggggttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcacgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatatacgatgtgttcaggaaagttttcaattgacaaagagatggcagaaacacagcatgggacgacagtggtgaaagtcaagtatgaaggtgctggagctccgtgtaaagtccccatagagataagagatgtaaacaaggaaaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagattatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttaggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctattgtgcctgaccttgtttgtggaagaatgcttgagaagaagagtcaccagaaaacacatgatattagctgtggtaatcactctttgtgctatcatcctggggggcctcacatggatggacttgctacgagccctcatcatgttgggggataccatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagcctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatagaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaagaatcccaaacatgtccaaacgaaacctggccttttcaagaccctaactggagaaattggagcagtaacattggatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaaccataatggacttacaccctggagctggaaagacaaaaagaattcttccatcaatagtgagagaagccttaaaaaggaggctgcggactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtggaaatgggagaggcagcagccatcttcatgaccgcaacccctcccggagcaacggatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtctgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaaaccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggacctcggtgtgccgctgttagcgatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttaatgagaacaacatgggctttctgtgaagtcttgactttggctacaggaccaaccttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggactgaagccaagtccgctctgaaagatgggtccaaaatcaagcatgcagtatctagagggtccagtaagatcagatggatcgttgagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacactctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggaatttggcagagccaagggaagccgagcaatctggtacatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggcgaggaaagacattccgcagtgggaaccatctaagggatggaagaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtactttcacagaagggatctgcgtttagcctccatggctatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7878 - RNA, 9867 nt, synthetic construct
  misc_feature 1..9867: note = derived and/or modified CDS sequence (wt) from DENV-4__KJ596663__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaaccatggggttacagccacgataactcccaggtcaccatcggttgaagtcaaactgccggactatggagaactaacacttgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggagaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagaaagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatattgggggacactatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcctggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattctggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtggaaatgggagaggcagcagccatcttcatgaccgcaacccctcccggagcgacggatccatttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagaccgggaatggtgcttcactggggaaagaaataaccaaattttagaagaaaacatggaggttgaaatttggactagagagggagaaaagaaaaaactgaggccaaaatggttagatgcacgtgtatatgctgaccccatggctttgaaggatttcaaggagtttgccagtggaaggaagagcataactctcgacatcctgacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggacctcggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagattagatggatcgtagagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagaaaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagaccctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7879 - RNA, 9867 nt, synthetic construct
  misc_feature 1..9867: note = derived and/or modified CDS sequence (wt) from DENV-4__KJ596664__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggggttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggtaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtggtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttctctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatgttgggggacactatgtctggcagaataggaggacagacccacctagccatcatagcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtagaaatgggagaggcagcagccatcttcatgaccgcaacccctcccggagcgacggatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttaaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggaccttggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactagtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggaccgaagccaagtccgccctgaaagatgggtccaaaatcaagcatgcagtatctagagggtccagtaagattagatggatcgttgagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaatagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggaacttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgtcagtaatgaaaagatacagtgctccttcagagagtgaaggagttctgtaa

SEQ ID NO: 7880 - RNA, 9867 nt, synthetic construct
  misc_feature 1..9867: note = derived and/or modified CDS sequence (wt) from DENV-4__KJ596665__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaaccatggggttacagccacgataactcccaggtcaccatcggttgaagtcaaactgccggactatggagaactaacacttgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggagaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcggtctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagaaagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatattgggggacactatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcctggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattctggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtggaaatgggagaggcagcagccatcttcatgaccgcaacccctcccggagcgacggatccatttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctgacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactgggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggacctcggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagattagatggatcgtagagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagaaaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaaaacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7881 - RNA, 9867 nt, synthetic construct
  misc_feature 1..9867: note = derived and/or modified CDS sequence (wt) from DENV-4__KJ596668__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttgagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaaccatggggttacagccacgataactcccaggtcaccatcggttgaagtcaaactgccggactatggagaactaacacttgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggagaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagaaagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatattgggggacactatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcctggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccagtcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattctggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagtcccaaactataaccttatagtaatggatgaagcacatttcaccgatccttccagtgtcgcggctagaggatacatctcgaccagggtggaaatgggagaggcagcagccatcttcatgaccgcaacccctcccggagcgacggatccatttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctgacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgttctaatggggcttggaaaaggatggccactccacagaatggacctcggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagattagatggatcgtagagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagaaaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtatggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7882 - RNA, 9867 nt, synthetic construct
  misc_feature 1..9867: note = derived and/or modified CDS sequence (wt) from DENV-4__KJ596670__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggggttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggtaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttctctatgggtctgttgtgcctgaccttgtttgtggaagaatgcttgagaagaagagtcaccagaaaacacatgatattagctgtggtaatcactctttgtgctatcgtcctggggggcctcacatggatggacttgctacgagccctcatcatgttgggggacactatgtctggcagaataggaggacagacccacctagccatcatagcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccagattggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtagaaatgggagaggcagcagccatcttcatgaccgcaacccctcccggagcgacggatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttaaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggaccttggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactagtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagttcgaagagtataaaagaagtggaatactagaagtggacaggaccgaagccaagtccgccctgaaagatgggtccaaaatcaagcatgcagtatctagagggtccagtaagattagatggatcgttgagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaatagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcatcctccatggtgaacggggtggtgaaactgctaacaaaaccctgggatgtaattccgatggtgactcagttagccatgacagacacaaccccttttgggcaacaaagagtgttcaaagagaaggtggataccagaacaccgcaaccaaaaccaggcacacgaatggttatgaccacgacggccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgtcagtaatgaaaagatacagtgctccttcagagagtgaaggagttctgtaa

SEQ ID NO: 7883 - RNA, 9867 nt, synthetic construct
  misc_feature 1..9867: note = derived and/or modified CDS sequence (wt) from DENV-4__KJ596671__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggggttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggtaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggagggcatgatctcactgtggtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttctctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatgttgggggacactatgtctggcagaataggaggacagacccacctagccatcatagcagtgttcaagatgtcaccaggatacgtgctgggtgtgtttttaaggaaactcacttcaagagagacagcactaatggtaataggaatggccatgacaacgacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtagaaatgggagaggcagcagccatcttcatgaccgcaacccctcccggagcaacggatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttaaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaacacgtcggccaacctatctttagcagccattgccaaccaggcagccgtcctaatggggcttggaaaaggatggccactccacagaatggaccttggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactagtcttgtgtgctggacaactactcttgatgagaacaacatgggctttctgtgaagtcttgactttggctacgggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggaccgaagccaagtccgccctgaaagatgggtccaaaatcaagcatgcagtatctagagggtccagtaagattagatggatcgttgagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtcctcaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaatagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgtcagtaatgaaaagatacagtgctccttcagagagtgaaggagttctgtaa

SEQ ID NO: 7884 - RNA, 9867 nt, synthetic construct
  misc_feature 1..9867: note = derived and/or modified CDS sequence (wt) from DENV-4__KJ579241__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaaccatggggttacagccacgataactcccaggtcaccatcggttgaagtcaaactgccggactatggagaactaacacttgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaagattcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgcaaagtccccatagagataagagatgtaaacaaggagaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtacacaaccatgtttggaggagtctcatggatgattagaatcctaattgggttcttagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagaaagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaacagtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgagaagaagagtcaccagaaaacacatgatattagctgtggtaatcactctttgcgctatcatcctggggggcctcacatggatggacttgctacgagccctcatcatattgggggacactatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcctggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattctggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtggaaatgggagaggcagcagccatcttcatgaccgcaacccctcccggagcgacggatccatttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctgacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggacctcggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagattagatggatcgtagagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacaatgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagaaaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttttggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7885 - RNA, 9867 nt, synthetic construct
  misc_feature 1..9867: note = derived and/or modified CDS sequence (wt) from DENV-4__KJ596672__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctactgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggggttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggtaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttctctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatgttgggggacactatgtctggcagaataggaggacagacccacctagccatcatagcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggagacttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtatcgcggctagaggatacatctcgaccagggtagaaatgggagaggcagcagccatcttcatgaccgcaacccctcccggagcgacggatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttaaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggaccttggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactagtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggaccgaagccaagtccgccctgaaagatgggtccaaaatcaagcatgcagtatctagagggtccagtaagattagatggatcgttgagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaatagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgtcagtaatgaaaagatacagtgctccttcagagagtgaaggagttctgtaa

SEQ ID NO: 7886 - RNA, 9867 nt, synthetic construct
  misc_feature 1..9867: note = derived and/or modified CDS sequence (wt) from DENV-4__KJ579242__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaaccatggggttacagccacgataactcccaggtcaccatcggttgaagtcaaactgccggactatggagaactaacacttgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgcaaagtccccatagagataagagatgtaaacaaggagaaagtggttgggcgcgttatctcagccacccctttggctgagaacaccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtacacaaccatgtttggaggagtctcatggatgattagaatcctaattgggttcttagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagaaagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaacagtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgagaagaagagtcaccagaaaacacatgatattagctgtggtaatcactctttgcgctatcatcctggggggcctcacatggatggacttgctacgagccctcatcatattgggggacactatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcctggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacaaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattctggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtggaaatgggagaggcagcagccatcttcatgaccgcaacccctcccggagcgacggatccatttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctgacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccattgccaaccaggcagccgtcctaatggggcttggaaaaggatggccactccacagaatggacctcggtgtgccgctgttagcaatgggatgctattctcaagtgaacccaacaaccttgacagcatccctagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggttttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagattagatggatcgtagagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacaatgagagttttgaagatggtggagccatggctctcttcaaaacctgaattctgcatcaaggtccttaacccctatatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagaaaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7887 - RNA, 9867 nt, synthetic construct
  misc_feature 1..9867: note = derived and/or modified CDS sequence (wt) from DENV-4__GQ398256__SS-prME
  source 1..9867: mol_type = other RNA
tcaacaatgacattgctgtgtttgattcccaccgtaatggcgtttcacttgtcaacaagagatggcgaacccctcatgatagtggcaaaacacgaaagggggagacctctcttgtttaagacaacagaaggaatcaacaaatgtacccttattgctatggacctgggtgaaatgtgcgaagacactgtcacgtacaagtgtcctctactggtcaacaccgaacctgaagacattgattgctggtgcaatctcacgtccacctgggtcatgtacgggacatgcacccagaacggagaacggagacgagagaagcgctcagtagctttaacaccacattcaggaatgggattggaaacaagagctgagacatggatgtcatcggaaggggcttggaaacatgctcagagagtagaaagctggatactcagaaacccaggattcgcgctcttggcaggattcatggcttatatgattgggcaaacaggaatccagcgaactgttttctttgtcctgatgatgctagtcgccccatcctacggaatgcgatgcgtaggggtagggaacagagactttgtggaaggagtctcgggtggagcatgggtcgacttggtgctagaacatggaggatgcgtcacaaccatggcccagggaaaaccaaccttggattttgaattgaccaagacaacagccaaggaagtggctctgttaagaacttattgcattgaagcctcgatatcaaacataaccacggcaacaagatgtccaacgcaaggagagccttatctcaaagaggagcaagaccaacagtacatttgccggagagacgtggtagacagagggtggggcaatggctgtggcttatttggaaaaggaggagttgtgacatgtgcgaagtttttatgctcggggaagataacaggcaatctggtccaaattgaaaaccttgaatacacagtagcagtaacagtccacaatggagacacccatgcagtaggaaatgacacatccagccatggagtgacagccacgataactcctaggtcaccatcggtagaagttaaattgccggactatggagaactaacacttgattgcgaacccaggtccggaattgattttaatgagatgatcctgatgaaaatgaaaaagaaaacgtggcttgtgcataagcaatggtttttagacctacctctaccatggacggcaggagcagacacatcagaagttcattggaatcataaagagagaatggtgacgttcaaggttcctcatgccaagagacaggatgtgacagtgctaggatctcaggagggagctatgcattctgccctcgccggagccacagaagtggattctggtgatggaaatcacatgtttgcaggacatctcaagtgcaaagtccgcatggagaaattgagaattaaaggaatgtcatacacgatgtgttcaggaaagttctcaattgacaaagagatggcagaaacacagcatggaacaacagtggtgaaagtcaagtatgaaggcgctggagctccgtgtaaagtccccatagagataagagatgtgaacaaggaaaaagtggtcgggcgtatcatctcatctaccccttttgctgagaataccaacagcgtaaccaacatagaattagaacccccttttggggacagctacatagtgataggtgttggagagagtgcattaacactccattggttcagaaaagggagctccattggtaagatgtttgagtccacatacagaggtgcaaaacgaatggccattctaggtgaaacagcttgggattttggttctgttggtggactgttcacatcattgggaaaggctgtacaccaggtttttggaagtgtgtatacaaccatgtttggaggggtctcatggatggttagaatcctaattgggttcttagtattgtggattggcacgaattcaagaaacacttcaatggcaatgacatgcatagctgttggaggaatcactctgtttctaggtttcacagttcaagcagacatgggttgtgtggtgtcatggaatgggaaggaattgaaatgtggaagcggaatttttgtggttgacaacgtgcacacttggacagaacagtacaaatttcaaccagagtccccagcgagactagcgtctgcaatattgaatgcccacaaagatggggtctgtggaattagatcaaccacgaggctggaaaatgttatgtggaagcaaataaccaacgagctaaactatgttctctgggaaggaggacatgacctcactgtagtggctggggacgtgaagggggtgttaaccaaaggcaagagagcactcacacctccagtgaatgatctaaaatattcatggaagacatgggggaaagcaaaaatctttaccccagaagcaagaaatagtacgtttttaatagacggaccagacacctccgaatgccccaatgagcgaagagcatggaacttttttgaggtagaagactatggatttggcatgtttacgaccaacatatggatgaaattccgagaaggaagttcagaagtgtgtgaccatagattaatgtcggcggcaatcaaagatcagaaagctgtgcatgctgacatgggttattggatagagagctcaaaaaaccagacctggcagatagagaaagcatcccttattgaagtgaaaacatgtctgtggcccaaaacccacacgctgtggagcaatggagtgttggaaagtcagatgctcattccaagatcatatgcaggccccttttcacagcacaattaccgtcagggctatgccacgcaaaccgtgggcccatggcacctaggcaaattggagatagactttggagaatgccccgggacaacagtcgcaattcgggaggattgtgatcacagaggcccatctttgagaaccaccactgcatctggaaaactggtcacgcaatggtgctgccgctcctgcacgatgcctcccttaaggttcttgggagaagatggatgttggtatgggatggagatcaggcctttgagtgaaaaagaagagaacatggtcaaatcacaggtaacggccggacagggcacatcagaaactttttctatggggctgctatgcctgaccttgtttgtggaagaatgcttgaggagaagagtcactaggaaacacatgatattggttgtggtaatcaccttttgtgctatcatcctaggaggtctcacatggatggacttactacgagcccttatcatgttaggggatactatgtctggtagaataggaggacagattcacctagccatcatggcagtgttcaagatgtcaccaggatatgtgctgggtgtgtttttaaggaaacttacttcaagagagacagcgctaatggtaataggaatggccatgacaacggtgttttcaatcccacatgacctcatggaactcattgatggaatatcattggggttgatattactaaaaatagtaacacattttgataacacccaagtgggaaccctagccctttccttgacttttttaagatcaacaataccattagtcatggcttggaggaccattatggctgtgttctttgtggtcacactcattcctttgtgcaggacaagctgtcttcaaaaacagtcccattgggtagaaataacagcactcatcctaggagcccaggctttgccagtgtacctaatgactctcatgaaaggagcctcaaggagatcttggcctcttaatgagggcataatggctgtgggtttggtgagcctcttaggaagcgccctcttgaagaatgatgttcctttggctggcccaatggtggcaggaggcttgcttctagcggcttacgtaatgagtggtagctcagcagacctgtcactagagaaagctgccaacgtgcagtgggatgaaatggcggacataactggctcaagcccaatcatagaagtgaagcaggatgaagatggctctttctccatacgggacgtcgaggaaaccaatatgataactctcttggtgaaactggcactgataacagtatcaggtctttaccccttggcaattccagtcacaatggcattatggtatatttggcaagtgaagacacaaagatcaggagctctgtgggacgtcccctcacccgctgccacccagaaagccacactgtctgaaggagtgtataggatcatgcaaagagggctgtttgggaaaactcaggttggagtaggaatacacatggaaggcgtatttcacacaatgtggcatgtaacaaggggatcagtgatctgccatgagacagggagattagagccatcttgggctgacgtcaggaacgacatgatatcatacggtgggggatggaggctcggagacaaatgggacaaagaagaagatgttcaggtcttagccatagaaccagggaaaaatcccaaacatgtccaaacgaaacctggccttttcaagaccctaactggagaaattggagcagtaactctggatttcaaacccggaacgtctggctctcccatcattaataagaaaggaaaagttattggactctatggaaatggagtagttaccaaatcaggtgattatgtcagtgccataacgcaagccgagagaattggtgagccagattatgaagtagatgaggacatttttcgaaagaaaagattaaccataatggatttacaccccggagctggaaagacaaaaagaatcctcccatcaatagtcagagaggctttaaaaaggaggctgcgaaccctgattttggctcccacgagagtggtggcggccgagatggaagaggccctacgtggattgccaatccgttatcagactccagctgtgaaatcagagcacacaggaagagagattgtagacctcatgtgtcatgcaaccttcacaacaagacttttgtcatcaaccagggttccaaattataacctcatagtgatggatgaagcacatttcactgacccttgcagtgtcgcggctagaggatacatttcaaccagggtggaaatgggagaggcagcagctatcttcatgactgcaacccctcctggagcgacagatcccttcccccagagcaacagcccaatagaagacatcgagagggaaattccagagaggtcatggaacacagggttcgactggataacagactaccaagggaaaactgtgtggtttgttcccagcataaaagctggaaatgacattgcaaattgtttgagaaagtcgggaaagagagtgatccagttgagcaggaaaacctttgacacagagtatccaaagacgaaactcacggactgggattttgtggtcaccacagacatatctgaaatgggggccaatttcagagctgggagagtgatagaccccaggagatgcctcaagccagttatcctaacagatgggccagagagagttattctagcaggtccaatcccagtaactccagcaagtgccgctcagagaagagggcgaataggtaggaatccagcacaggaagatgaccaatatgttttctccggagacccactaaaaaatgatgaagatcatgctcactggacagaagcaaagatgctgcttgacaatatctacacccctgaagggataattccaacactgtttggtccggaaagggaaaaaacccaagccattgatggagagtttcgcctcagaggggaacaaaggaagacttttgtggaattaatgaagagaggagaccttccggtgtggctgagctacaaggtagcttctgccggtatctcttacaaagatcgagaatggtgcttcacaggagaaaggaataaccaaattttagaagaaaacatggaggttgaaatttggactaaagagggagaaaagaaaaagctaaggccaaaatggttagatgcacgtgtgtacgctgatcccatggctttgaaggatttcaaggagtttgccagtggaagaaagagcataactctcgacatcctaacagagattgccagtttgccaacttacctttcctctaaggccaagctggcccttgacaacatagttatgctccacacaacagaaaaaggagggagggcctaccaacacgccctgaacgaactcccggagtcactggaaacactcatgcttgtagctctactaggtgctatgacagccggcatcttcctgtttttcatgcaggggaaaggaataggaaaattgtcaatgggtctaatagccatagccgtggctagtggcttgctctgggtagcagaaattcagccccagtggatagcagcttcaatcatactggagttctttcttatggtgctgttgataccagaaccagaaaaacaaaggaccccacaagacaatcaattgatctacgtcatattgaccattctcaccatcatcggtcttatagcagccaatgagatggggctgattgaaaaaacaaaaactgactttgggttttaccaggtaaaaacagaaaccactattcttgatgtggatttgagaccagcctcagcatggacactctatgcggtagccaccaccattctgactcccatgctgagacacaccatagaaaacacgtctgccaacctatctttagcagccattgccaaccaagcagctgtcctaatgggacttggaaaaggatggccgctccacagaatggacctcggtgtgccgctgttagcaataggatgttattctcaagtgaacccaacaaccctgacagcatccttagtcatgcttttagtccattatgccataataggtccaggattgcaggcaaaagccacacgagaggcccagaaaaggacagctgctgggatcatgaagaaccctacggtggacgggataacagtaatagatctagaaccaatatcctatgacccaaaatttgaaaagcaattagggcaagtcatgctactagtcctgtgtgttggacaattacttttgatgagaacaacatgggctctctgcgaagtcttgactttggccacaggaccagccatgaccttgtgggagggcaacccgggaaggttttggaacacgaccatagctgtatccacagccaacattttcagaggaagctacttggcaggagctggactagctttttcgctcataaagaatgcacaaacccctaggaggggaactgggaccacaggagagacactgggagagaagtggaagagacagctaaactcattagacagaaaagagtttgaagagtacaaaagaagtggaatactagaagtggataggactgaagccaagtctgccctaaaagatggatctaaaatcaagcatgcggtgtccagagggtctagtaagatcagatggattgttgaaagagggatggtaaagccaaaagggaaggtcgtggatctcggttgcgggaggggaggatggtcctattacatggcgacactcaagaacgtgactgaagtgaaaggatatacaaaaggaggtccaggacatgaggaaccaatccccatggctacttatggctggaacttggtcaaactccattcaggggttgatgtgttttacaaacccactgagcaggtggacaccttgctctgtgacattggggagtcgtcctctaatccgacaatagaggaaggaagaacattgagagtcttgaagatggtggagccatggctctcttcaaaacctgagttctgcatcaaagtcctcaacccctatatgccaacagttatagaagagctggagaaactccagagaagatatggtggaagcctcgtcagatgccctctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtggatcttggggcaggaacgagaagtgtctccactgaaacagaaaaaccagacatgacagttattgggagaaggcttcagagattgcaagaagagcacaaagaaacctggcactatgaccaggaaaacccatacagaacctgggcgtatcatggaagctatgaagctccttcgacaggctcagcatcctccatggtgaatggaatagtgaaactgctgacaaaaccctgggatgtgattccaatggtgacccagttggccatgacagacacaaccccttttgggcaacaaagagtgttcaaggagaaggtggataccagaacaccacaaccaaaacccggcacacgaatgattatgaccacgacagccaattggctgtgggctctcctcgggaagaagaaaagtcccagattgtgtacaagggaagagttcatctcaaaagttaggtcaaatgcagccataggcgcagtctttcaggaagaacagggatggacatcagccagtgaagctgtgaatgacagccggttctgggaactggttaacaaagaaagggctctgcaccaggaaggaaaatgtgaatcgtgtgtctataacatgatgggaaaacgtgagaaaaaattaggagagtttggtagggccaagggaagccgagcaatctggtacatgtggctgggggcgcggttcctggaatttgaagccctgggtttcttgaatgaagatcactggtttagcagagaaaactcatggagtggagtggaaggggaaggtctgcacagattgggatatatcttggaggatatagacaagcaggatggagatctaatatatgctgacgacacagcaggctgggacacgagaatcactgaggatgaccttttaaatgaagaactgatcacagaacagatggccccccaccacaagaccctagccaaagccattttcaaactaacctatcaaaacaaagtggtgaaagtcctcagacccacaccgaaaggagcggtgatggacatcatatccaggaaagaccaaagaggtagtggacaggttggaacatatggtttaaacacattcactaacatggaagttcaactcatccgccaaatggaagctgaaggagtcatcacacaagacgacatgcagaacccaaaagggttgaaagaaagagttgagaaatggctgacagagtgtggcgtcgacaggttgaagaggatggcaatcagtggagatgactgcgtggtgaaacccctagatgagaggttcagcgcttccctcctcttcttgaacgacatgggaaaggtgaggaaagacatcccgcagtgggaaccatccaagggatggaaaaactggcaagaggtccctttttgctcccaccattttcataagatctttatgaaagatggccgctcactagttgttccatgcagaaaccaggatgaactgataggaagagccagaatctcgcagggggctggatggagcctaagagaaacagcctgtttgggcaaagcttacgcccaaatgtggtcgcttatgtatttccatagaagggacctgcgtttagcctccatggccatatgttcagcagttccaacggaatggtttccaacaagcaggacaacatggtcaatccacgctcatcaccagtggatgaccactgaagacatgctcaaagtgtggaacagggtgtggatagaagacaaccccaatatgactgacaagactccagtccattcgtgggaagacataccttacctagggaaaagagaggatttgtggtgtggatccctgattggactctcttccagagccacctgggcgaagaacattcacacggccataacccaggtcaggaatctgatcggaaaagaggaatacgtggattacatgccagtcatgaaaagatacagcgctccttccgaaagtgaaggagttctgtaa

SEQ ID NO: 7888 - RNA, 9867 nt, synthetic construct
  misc_feature 1..9867: note = derived and/or modified CDS sequence (wt) from DENV-4__KC333651__SS-prME
  source 1..9867: mol_type = other RNA
tcaacaatgacattgctgtgtttgattcccaccgtaatggcgtttcacctgtcaacaagagatggcgaacccctcatgatagtggcaaaacacgaaagggggagacctctcttgtttaagacaacagaagggatcaacaaatgtacccttattgctatggacctgggtgaaatgtgcgaagacactgtcacgtataagtgtcctctactggttaacaccgaacctgaagacattgactgctggtgcaatctcacgtccacctgggtcatgtacgggacatgcacccagaacggagaacggagacgagagaagcgctcagtagctttaacaccacattcaggaatgggattggaaacaagagctgagacatggatgtcatcggaaggggcttggaaacatgctcagagagtagaaagctggatactcagaaacccaggattcgcgctcttggcaggatttatggcttacatgattgggcaaacaggaatccagcgaattgttttctttgtcctgatgatgctagtcgccccatcctacggaatgcgatgcgtaggggtagggaacagagacttcgtggaaggagtctcgggtggagcatgggtcgacttggtgctagaacatggaggatgcgtcacaaccatggcccagggaaagccaaccttggattttgaattgactaagacaacagccaaggaagtagctctgttaagaacctattgcattgaagcctcgatatcaaacataaccacggcaacaagatgtccaacgcaaggagagccttatctcaaagaggagcaagaccaacagtacatttgccggagagacgtggtagacagaggatggggcaatggctgtggcttatttggaaaaggaggagttgtgacatgtgcaaagtttttatgctcggggaagataacaggcaatctggtccaaattgaaaaccttgaatacacagtagtagtaacagtccacaatggagacacccatgcagtaggaaatgacacatccaaccatggagtgacagccacaataactcctaggtcaccatcggttgaagttaaattgccggactatggagaactaacactcgattgcgagcccaggtccggaattgattttaatgagatgatcctgatgaagatgaaaaagaaaacgtggcttgtgcataagcaatggtttttagacctacctctaccatggacggcaggagcagatacatcagaagttcattggaatcataaagagagaatggtgacattcaaggttcctcatgccaagagacaggatgtgacagtgctaggatctcaggagggagctatgcattctgccctcgccggagccacagaagtggattctggtgatggaaatcacatgtttgcaggacatctcaagtgcaaagtccgcatggagaaattgagaattaaaggaatgtcatacacgatgtgttcaggaaagttctcaattgacaaagagatggcagaaacacagcatggaaccacagtggtgaaagtcaagtatgaaggcgctggagctccgtgtaaagttcccatagagataagagatgtgaacaaggaaaaagtggtcggacgtatcatctcatctaccccttttgctgagaataccaacagcgtaaccaacatagaattagaacccccttttggggacagctacatagtgataggtgttggagagagtgcattaacactccattggttcagaaaagggagctccattggcaagatgtttgagtccacatacagaggtgcaaaacgaatggccattctaggtgaaacagcttgggattttggctctgttggtggactgttcacatcattgggaaaggccgtacaccaggtttttggaagtgtgtatacaactatgtttggaggggtctcatggatggttagaatcctaattgggttcttagtattgtggattggcacaaattcaagaaacacttcaatggcaatgacgtgcatagctgttggaggaatcactctgtttctgggtttcacagttcaagcagacatgggttgtgtggtgtcatggaatgggaaggaattaaaatgtggaagcggaatttttgtggttgacaacgtacacacttggacagaacagtacaaatttcaaccagagtccccagcaagactagcgtctgcaatattgaatgcccacaaagatggggtctgtggaattagatcaaccacgaggctggaaaatgttatgtggaagcaaataaccaatgagctaaactatgttctctgggaaggaggacatgacctcactgtagtggctggggatgtgaagggggtgttgaccaaaggcaagagagcactcacacctccagtgaatgatctgaaatattcatggaagacatgggggaaagcaaaaatctttaccccagaagcaagaaacagtacgtttttaatagacggaccagacacctccgaatgccccaatgagcgaagagcatggaacttttttgaggtagaagactatggatttggcatgttcacgaccaacatatggatgaaattccgagaaggaagttcagaagtgtgtgaccatagactaatgtcggcggcaatcaaagatcagaaagctgtgcatgctgacatgggttattggatagagagctcaaaaaaccagacctggcagatagagaaagcatcccttattgaagtgaaaacatgtctgtggcccaaaacccacacgctgtggagcaatggagtgctggaaagtcagatgctcattccaagatcatatgcaggccccttttcacagcacaattaccgtcagggctatgccacgcaaaccgtgggcccatggcacctaggcaaattggagatagactttggagaatgccccgggacaacagtcgcaattcgggaggattgtgaccacagaggcccatctttgagaaccaccactgcatctggaaaactggtcacgcaatggtgctgccgctcctgcacgatgcctcccttaaggttcttgggagaagatggatgttggtatgggatggagatcaggcctctgagtgaaaaagaagagaacatggtcaaatcacaggtaacggccggacagggcacatcagaaactttttctatggggctgttatgcctgaccttgtttgtggaagaatgcttgaggagaagagttactaggaaacacatgatattggttgtggtaatcaccttttgcgctatcatcctaggaggtctcacatggatggacttactacgagcccttatcatgttaggggatactatgtctggtagaataggaggacagatccacctagccatcatggcagtgtttaagatgtcaccaggatacgtgctgggtgtgtttttaaggaaacttacttcaagagagacagcgctgatggtaataggaatggccatgacaacggtgttttcaatcccacatgacctcatggaactcattgatggaatatcattggggttgatattactaaaaatagtaacacattttgacaacactcaagtgggaaccctagccctttccttgacttttttaagatcaacaataccattagtcatggcttggaggaccattatggctgtgttctttgtggtcacactcattcctttgtgcaggacaagctgtcttcaaaaacattcccactgggtagaaataacagcactcatcctaggagcccaggctttgccagtgtacctaatgactctcatgaagggagcctcaaggagatcttggcctctcaatgagggcataatggctgtaggtttggtgagcctcttaggaagcgccctcttgaagaatgatgttcctttggctggcccaatggtggcaggaggcttgcttctagcggcttacgtaatgagtggtagctcagcagacctgttactagagaaagctgccaacgtgcagtgggatgaaatggcggacataactggctcaagcccaatcatagaagtgaagcaggatgaagatggctctttttccatacgggacgtcgaggaaaccaatatgatgactctcttggtgaaactggcactgataacagtatcaggtctttaccccttggcaattccagtcacaatggcattatggtatatttggcaagtgaagacacaaagatcaggagctctgtgggacgtcccctcacccgctgccacccagaaagccacactgtctgaaggagtgtataggattatgcaaagagggctgtttgggaaaactcaagttggagtaggaatacacatggaaggcgtatttcacacaatgtggcatgtaacaaggggatcagtgatctgccatgagacagggagattagagccatcttgggctgacgtcagaaacgacatgatatcatacggtgggggatggaggctcggagacaaatgggacaaagaagaagatgttcaggttttagccatagaaccagggaaaaatcccaaacatgtccaaacgaaacctggccttttcaagaccctaactggagaaattggagcagtaactctggatttcaaacccggaacgtctggctctcccattattaacaagaaagggaaagttattggactctatggaaatggagtggttaccaaatcaggtgattatgtcagtgccataacgcaagccgagagaattggtgagccagattatgaagtagatgaggacatttttcgaaagaaaagattaaccataatggatttacaccctggagctggaaagacaaaaagaatcctcccatcaatagtcagagaggccttaaaaaggaggctgcgaaccctgattttagctcccacgagagtggtggcggccgagatggaagaggccctacgtggattgccaatccgttatcagactccagctgtgaaatcagagcacacaggaagagagattgtagacctcatgtgtcatgcaacctttacaacaagacttttgtcatcaaccagggttcctaattataacctcatagtgatggatgaagcacatttcactgacccttgcagtgtcgcggctagagggtacatttcaaccagggtggaaatgggagaggcagcagctatcttcatgactgcaacccctcctggagcgacagatcccttcccccagagcaacagcccaatagaagacatcgagagggaaattccagaaaggtcatggaacacagggttcgactggataacagactaccaagggaaaactgtgtggtttgttcccagcataaaagctggaaatgacattgcaaattgtttgagaaagtcgggaaagagagtgatccagttgagcaggaaaacctttgacacggagtatccaaagacgaaactcacggactgggattttgtggtcaccacagatatatctgaaatgggggccaatttcagagctgggagagtgatagaccccaggagatgcctcaagccagttatcctaacagatgggccagagagagttattctagcaggtccaatcccagtaactccagcaagtgccgctcagagaagagggcgaataggtaggaatccagcacaggaagatgaccaatatgttttctccggagacccactaaaaaatgatgaagatcatgctcactggacagaagcaaagatgctgcttgacaatatctacacccctgaagggataattccaacactgtttggtccggaaagggaaaaaacccaagccatcgatggagagtttcgcctcagaggggaacaaaggaagacttttgtggaattaatgaagagaggagaccttccggtgtggctgagctacaaggtagcttctgccggtatctcctacaaagatcgagaatggtgcttcacaggagaaaggaataaccaaattttagaagaaaacatggaggttgaaatttggactaaagagggagaaaagaaaaagctaaggccaaaatggttggatgcacgtgtgtacgctgatcccatggctttgaaggatttcaaggagtttgccagtggaagaaagagcataactctcgacatcctaacagagattgccagtttgccaacttacctttcctctaaggccaagctggctcttgacaacatagtcatgctccacacaacagaaaaaggagggagggcctaccaacacgccctgaacgaactcccagaatcactggaaacgctcatgcttgtagctctactaggtgctatgacagcaggcatcttcctgtttttcatgcaggggaaaggaataggaaaattgtcaatgggtctaatagccatagctgtggctagtggcttgctctgggtagcagaaattcagccccagtggatagcagcttcaatcatactggagttctttcttatggtgctgttgataccagaaccagaaaaacaaaggaccccacaagacaatcaattgatctacgtcatattgaccattctcaccatcatcggtcttatagcagccaatgagatggggctgattgaaaaaacaaaaactgactttgggttttaccaggtaaaaacagaaacaactattcttgatgtggatttgagaccagcctcagcatggacactttatgcggtagccaccaccattctgactcccatgctgagacacaccatagaaaacacgtctgccaacctatctctagcagccattgccaaccaagcagctgttctaatgggacttggaaaaggatggccgctccacagaatggacctcggtgtgccgctgttagcaataggatgttattctcaagtgaacccaacaaccctgacagcatccttagtcatgcttttagtccattatgccataataggtccaggattgcaggcaaaagccacacgagaggcccagaaaaggacagctgctgggatcatgaagaaccccacggtggacgggataacagtaatagatctagaaccaatatcctatgacccaaaatttgaaaagcaattagggcaagtcatgctactagtcctgtgtgctggacaattacttttgatgagaacaacatgggctctctgcgaagtcttgactttggccacaggaccagccatgaccttgtgggagggcaacccaggaaggttttggaacacgaccatagctgtatccacagccaacattttcagaggaagctatttggcaggagctggactagctttttcgctcataaagaatgcacaaacccctaggaggggaactgggaccacaggagagacactgggagagaagtggaagagacagttaaactcattagacagaaaagagtttgaagagtacaaaagaagtggaatactagaagtggataggactgaagccaagtctgccctaaaagatggatctaaaatcaagcatgcggtgtccagagggtctagtaagatcagatggattgttgaaagagggatggttaagccgaaagggaaggtcgtggatcttggttgcgggaggggaggatggtcctattacatggcgacactcaagaacgtgactgaagtgaaaggatatacaaaaggaggtccaggacatgaggaaccaatccccatggctacttatggctggaacttggtcaaactccattcaggggttgatgtgttttacaaacccactgagcaggtggacaccttgctctgtgacattggggagtcgtcctctaatccgacaatagaggaaggaaggacattgagagtcttgaagatggtagagccatggctctcttcaaaacctgagttctgcatcaaagtcctcaacccctacatgccaacagttatagaagagctggagaaactccagagaagatatggcggaagcctcgtcagatgccctttatccaggaattccacccatgagatgtattgggtgtcaggtgcgtcgggaaacatcgtgagttctgtgaacacaatatcaaagatgctgttgaacaggttcacaacaaggcataggaaacccacttatgagaaggacgtggatcttggggcaggaacgagaagtgtctccactgaaacagaaaaaccagacatgacagttattgggagaaggcttcagagattgcaagaagagcacaaagaaacctggcactatgaccaggaaaacccatacagaacctgggcgtatcatggaagctatgaagctccttcgacaggctcagcatcctccatggtgaacggggtagtaaaactgctgacaaaaccctgggatgtgattccaatggtgacccagttggccatgacagacacaaccccttttgggcaacaaagagtgttcaaggagaaggtggataccagaacaccacaaccaaaacccggcacacgaatgattatgaccacgacagccaattggctgtgggctctcctcgggaagaagaaaagtcccagattgtgtacaagggaagagttcatctcaaaagttaggtcaaatgcagccataggcgcagtctttcaggaagaacaaggatggacatcagccagtgaagctgtgaatgacagccggttctgggaactggttgacaaagaaagggctctgcaccaggaaggaaaatgtgaatcgtgtgtctataacatgatgggaaagcgtgagaaaaaattaggagagtttggtagggccaagggaagccgagcaatctggtacatgtggctaggggcgcggttcctggaatttgaagccctgggtttcttgaatgaagatcactggtttagcagagaaaactcatggagtggagtggaaggggaaggtctgcacagattgggatatatcttggaggatatagacaagcaggaaggagatctaatatatgctgacgacacagcaggctgggacacgagaatcactgaggatgaccttttaaatgaagaactgatcacagaacagatggccccccatcacaagactctagccaaagccattttcaaactaacctatcaaaacaaagtggtgaaagtcctcagacccacaccgaaaggagcggtgatggacatcatatccaggaaagaccaaagaggtagtggacaggttggaacatatggtttaaacacattcactaacatggaagttcaactcatccgccaaatggaagctgaaggagtcatcacacaagacgacatgcagaacccaaaagggttgaaagaaagagttgagaaatggctgacagagtgtggcgtcgacaggttgaagaggatggcaatcagtggagatgattgcgtggtgaagcccctagatgagaggttcagcacctccctcctcttcttgaacgatatgggaaaggtgaggaaagacatccctcagtgggaaccatccaagggatggaaaaactggcaagaggttcctttttgctcccaccattttcataagatctttatgaaagatggccgctcactagttgttccatgcagaaaccaggatgaactgataggaagagccagaatctcgcaaggggctggatggagcttaagagaaacagcctgtttgggcaaagcttacgcccaaatgtggtcgcttatgtatttccatagaagggacctacgtttagcctccatggccatatgttcagcagttccaacggaatggtttccaacaagcaggacaacatggtcaatccacgctcatcaccagtggatgaccactgaagacatgctcaaagtgtggaacagggtgtggatagaagacaaccccaatatgactgacaagactccagtccattcgtgggaagacataccttacctagggaaaagagaggatttgtggtgtggatccctgattggactctcttccagagccacctgggcgaagaacattcacacggccataacccaggtcaggaatctgatcggaaaagaggactacgtggattacatgccagtcatgaaaagatacagcgctccttccgaaagtgaaggagttctgtaa

SEQ ID NO: 7889 - RNA, 9867 nt, synthetic construct
  misc_feature 1..9867: note = derived and/or modified CDS sequence (wt) from DENV-4__JN559740__SS-prME
  source 1..9867: mol_type = other RNA
tcaacgataacattgctgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggactggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccgtgcagtaggaaatgacatatccaatcatggagttacagccatgataactcccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggattgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggaaggaggacatgacctcactgtagtggctggggatgtgaagggggtgttgaccaaaggcaagagagcactcacacccccagtgagtgatctgaaatattcatggaagacatggggaaaagcaaaaatcttcaccccagaagcaagaaacagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcacaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccagggaaaaatcctaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttatcagaccccagccgtgaaatcagaacacacaggaagagagattgtagacctcatgtgtcatgcaaccttcacaacaagacttttgtcatcaaccagggttccaaattacaaccttatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgacacagagtatccaaaaacgaaactcacggactgggactttgtggtcactacagacatatctgaaatgggggccaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaagaaataaccaaattttagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgataacatagtcatgctccacacaacagaaagaggagggagggcctatcaacacgccctgaacgaacttccggagtcactggaaacactcatgcttgtagctttactaggtgctatgacagcgggtatcttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccagaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgaaaccagcttcagcatggacgctctatgcagtagccaccacaattctgactcccatgctgagacacaccatcgaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaataaccttgacagcatccttagtcatgcttttagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgtacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtgtctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggagggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctatgaagctccttcgacaggctctgcatcctccatggtgaacggggtagtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggcttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 7890 - RNA, 9867 nt, synthetic construct
  misc_feature 1..9867: note = derived and/or modified CDS sequence (wt) from DENV-4__JN559741__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtacaaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggagcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggggttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaacaccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttgggggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggacgtgaaaggggtgttgaccaagggcaagagagcactcacacccccagcgagcgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggctgatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggagagccagatgcttattccaaaatcatatgcaggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgagaagaagagtcaccagaaaacacatgatattagctgtggtaatcactctttgtgctatcatcctggggggcctcacatggatggacttgctacgagccctcatcatgttgggggacactatgtctggcagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgctgtttgtggtcacactcattcctttgtgtaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgttccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcggaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatctcgaccagggtggaaatgggagaggcagcagccatcttcatgaccgcaacccctcccggagcgacggatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgaggaagtcgggaaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccaaagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacctacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaaggtaaaggaatagggaaattgtcaatgggtttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaacacgtcggccaacctatctttagcagccattgccaaccaggcagccgtcctaatggggcttggaaaaggatggccactccacagaatggacctcggtgtgccgctgttagcaatgggatgctattctcaagtgaacccaacaaccttgacagcatccttagtcatgcttctagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccgcaggagagacactgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagatcagatggatcgttgagagagggatggtaaagccaaaagggaaagttgtagatcttggctgtgggagaggaggatggtcttattacatggcaacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattgagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaagaaaacccatacagaacctgggcgtatcatggaagctatgaagctccttcgacaggctctgcgtcctccatggtgaacggggtggtgaaactgctaacaaaaccctgggatgtaattccgatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtcttccaagaggaacagggatggacatcagccagtgaagctgtgaatgacagccggttttgggaactggttgacaaagaaagggcccttcaccaagaagggaaatgtgaatcgtgtgtctacaacatgatgggaaaacgtgagaaaaagttaggggagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgacctccaaaatgaggaactgatcacggaacagatggctccccaccacaagatcctagccaaagccattttcaaactaacctaccaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaaccctaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcttgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcatcaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattatatgccagtaatgaaaagatacagtgctccttcagagagtgaaggagttctgtaa

SEQ ID NO: 7891 - RNA, 9867 nt, synthetic construct
  misc_feature 1..9867: note = derived and/or modified CDS sequence (wt) from DENV-4__JQ513334__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgcgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccatggaagtggctctgttaagaacctattgtattgaagcctcaatatcaaacataactacggcaacaagatgtccaacacaaggagagccttatctgaaagaggaacaggaccaacagtacatctgccggagagatgtggtagacagaggatggggcaatggctgtggcttgtttggaaaaggaggagttgtgacatgtgcgaagttctcatgttcggagaagataacaggcaatctggtccaaattgagaaccttgaatacacagtggttgtaacagtccacaacggagacacccatgcagtaggaaatgacacatccaatcatggagttacagccacgataactcccaggtcaccatcggtagaagtcgaactgccggactatggagaactaacactcgattgtgaacccaggtctggaattgactttaatgaaatgatcttaatgaaaatgaaaaagaagacatggctcgtgcataagcaatggtttttagatctgcctcttccatgggcagcaggagcagacacatcagaggttcactggaattacaaagagagaatggtgacattcaaggttcctcatgccaagagacaggatgtgacagtgctcggatctcaggaaggagccatgcactctgccctcgctggagccacagaagtggactccggtgatggaaaccacatgtttgcaggacatctcaagtgcaaagtccgtatggagaaattgagaatcaaaggaatgtcatacacgatgtgttcaggaaagttttcaattgacaaagagatggcagaaacacagcatgggacaacagtggtgaaagtcaagtatgaaggtgctggagctccgtgcaaagtccccatagagataagagatgtaaacaaggaaaaagtggttgggcgcgttatctcttccatccctttggctgagaataccaacagtgtaaccaacatagaattagaacccccctttggggacagctacatagtgataggtgttggaaacagcgcactaacactccattggttcaggaaagggagttccattggcaagatgtttgagtccacctacagaggtgcaaaacgagtagccattctaggtgagacagcttgggattttggttccgttggtggactgttcacatcactgggaaaggctgttcaccaggtttttggaagtgtgtatacaaccatgtttggaggagtctcatggatggttagaatcttgattgggttattagtgttgtggattggcacgaattcaaggaacacttcaatggcgatgacgtgcatagctgttggaggaatcactctgtttttgggcttcacagttcaagcggacatgggttgtgtggtgtcatggagtgggagagagttgaagtgtggaagcggaatttttgtggttgacaacgtgcacacttggacagaacagtacaaattccaaccagagtccccagcgagactggcgtctgcaatattaaatgcccacaaagatggggtctgtggaattagatcaaccacgaggctggaaaatgtcatgtggaagcaaataaccaatgagctaaactatgtcctctgggaaggaggacatgatctcactgtagtggctggggatgtgaagggggtgttgaccaaaggcaagagagcactgacacccccagtgagtgatctgaaatattcatggaagacatggggaaaagcaaaaatcttcacccctgaagcaagaaacagcacatttttgatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttgatgtcagctgcaattaaagatcagaaagctgtgcatgctgacatgggttattggatagagagctcaaaaaaccagacctggcagatagagaaagcatcacttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaagattgtgaccataggggcccatctttgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaagtcacaggtggcggccggacagggcacatcagaaactttttctatgggtctgttgtgcctgaccttgtttgtggaagaatgcttgaggagaagggtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggcgcccaagctctgccagtgtacctaatgactcttatgaaaggagcctcaagaagatcttggcctcttaacgagggcataatggctgtgggtttggttagtctcttagggagcgctcttttaaagaatgatgtccctttagctggcccaatggtggcaggaggcttacttctggcggcttacgtgatgagtggcagctcagcagatctgtcacttgagaaggccgctaatgtgcagtgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctgtaccccttggcaatcccagtcacaatgaccttatggtacatgtggcaagtgaaaacacaaagatcaggagccctgtgggacgtgccctcacccgctgccactcaaaaagccgcactgtctgaaggagtgtacaggatcatgcaaagagggttattcgggaaaactcaggttggagtagggatacatatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtggtcaccaaatcaggtgattacgtgagtgccataacgcaagccgaaagaattggagagccagattatgaagtggatgaggatatttttcgaaagaaaagattaactataatggacttacaccccggagctggaaagacaaaaagaattcttccatcaatagtgagagaagccttaaaaaggaggctgcgaactttgattctggctcccacgagagtggtggcggccgagatggaagaggccctacgtggactgccaatccgttaccagaccccagctgtgaaatcagaacacacaggaagagagattgtagaccttatgtgtcatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacattgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggaccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatatgctgaccccatggctttgaaggatttcaaggagtttgccagcggaaggaagagtataactctcgacatcctaacagagattgccagcttgccaacttacctttcctctagggccaagctcgcccttgacaacatagtcatgctccacacaacagaaagaggagggagggcctatcaacacgccctgaacgaacttccggagtcactcgaaacactcatgcttgtagccttactaggtgctatgacagcaggcatcttcctgtttttcatgcaagggaaaggaatagggaaattgtcaatgggtttgataaccattgcggtggctagtggcttgctttgggtagcagaaattcaaccccagtggattgcggcctcaatcatactggagttttttctcatggtactgttgataccagaaccagaaaaacaaaggaccccacaagacaatcaattgatctacgtcatattggccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccattgccaaccaggcagccgtcctaatggggcttggaaaaggatggccgctgcacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtcgacgggataacagtaatagatctagaaccaatatcctatgacccaaaatttgaaaagcaattagggcaggtcatgctactagtcttgtgtgctggacaactactcttgatgagaacaacctgggctttctgtgaagtcttgactttggccacaggaccaatcttgaccttgtgggagggcaacccgggaaggttttggaacacgaccatagctgtatccaccgccaacattttcaggggaagttacttggcgggagctggactggctttttcactcataaagaatgcacaaacccctaggaggggaactgggaccacaggagagacactgggagagaagtggaagagacagctaaactcattagacaggaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacgctcaagaacgtgactgaagtgaaagggtatacaaaaggaggtccaggacatgaagaaccgattcccatggctacttatggctggaatttggtcaaactccattcaggggttgacgtcttctacaaacccacagagcaagtggacaccctgctctgcgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacagattcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctcgatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagtcagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgagcaatctggtacatgtggctcggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtaatggatatcatatccaggaaagaccaaagaggtagcggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttcactcctcttcttgaacgacatgggaaaggtgaggaaagacattccgcagtgggaaccatctaagggatggaaaaactggcaagaggtgcctttttgctcccatcactttcacaagatctttatgaaggatggccgctcactagttgttccatgtagaaaccaggatgaactgatagggagagccagaatctcgcagggggctggatggagcttaagagaaacagcctgcctgggcaaagcttacgcgcagatgtggtcgcttatgtacttccacagaagggatctgcgtttagcctccatggccatctgctcagcagttccaacggaatggtttccaacaagcagaacaacatggtcaatccatgctcatcaccaatggatgaccactgaagacatgctcaaagtgtggaacagagtgtggatagaagacaaccccaatatgattgacaagactccagtccattcgtgggaagatattccttacctagggaaaagagaggatttgtggtgtggatccctgattggactttcgtctagagccacctgggcgaagaacattcacacggccataactcaggtcaggaacctgatcggaaaagaggaatacgtcgattacatgccagtaatgaaaagatacagtgctccttcagagagtgaaggagttctgtaa

SEQ ID NO: 7892 - RNA, 9867 nt, synthetic construct
  misc_feature 1..9867: note = derived and/or modified CDS sequence (wt) from DENV-4__JQ513336__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgcgaggacactgtcacgtataaatgccccctactggtgaataccgaacctgaagacattgattgctggtgcaacctaacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgtattgaagcctcaatatcaaacataactacggcaacaagatgtccaacacaaggagagccttatctgaaagaggaacaggaccaacagtacatctgccggagagatgtggtagacagaggatggggcaatggctgtggcttgtttggaaaaggaggagttgtgacatgtgcgaagttctcatgttcggagaagataacaggcaatctggtccaaattgagaaccttgaatacacagtggttgttacagtccacaacggagacacccatgcagtaggaaatgacacatccaatcatggagttacagccacgataactcccaggtcaccgtcggtcgaagtcgaactgccggactatggagaactaacactcgattgtgaacccaggtccggaattgactttaatgaaatgatcttaatgaaaatgaaaaagaaaacatggctcgtgcataagcaatggtttttggatctgcctcttccatgggcagcaggagcagacacatcagaggttcactggaattacaaagagagaatggtgacattcaaggttcctcatgccaagagacaggatgtgacagtgctgggatctcaggagggagccatgcactctgccctcgctggagccacagaagtggactccggtgatggaaaccacatgtttgcaggacatctcaagtgcaaagtccgtatggagaaattgagaatcaaaggaatgtcatacacgatgtgttcaggaaagttttcaattgacaaagagatggcagaaacccagcatgggacaacagtggtgaaagtcaagtatgaaggtgctggagctccgtgcaaagtccccatagagataagagatgtaaacaaggaaaaagtggttgggcgcgttatctcatccatccctttggctgagaataccaacagtgtaaccaacatagaattagaacccccctttggggacagctacatagtgataggtgttggaaacagcgcattgacactccattggttcaggaaagggagttccattggcaagatgtttgagtccacatacagaggtgcaaaacgaatggccattctaggtgagacagcttgggattttggttccgttggtggactgttcacatcactcggaaaggctgtgcaccaggtttttggaagtgtgtatacaaccatgtttggaggagtctcatggatggttagaatcttgattgggttattagtgttgtggattggcacgaattcaaggaacacttcaatggcaatgacgtgcatagctgttggaggaatcactctgtttttgggcttcacagttcaagcggacatgggttgtgtggtgtcatggagtgggagagagttgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgtcctctgggaaggaggacatgatctcactgtagtggctggggatgtgaagggggtgttgaccaaaggcaagagagcactgacacccccagtgagtgatctgaaatattcatggaagacatggggaaaagcaaaaattttcacccctgaagcaagaaacagcacatttttaatagacggaccagacacctctgaatgccccaatgaacgaagagcatggaattctcttgaggtggaagactatggatttggcatgttcacgaccaacatctggatgaaattccgagaaggaagttcagaagtgtgtgaccacaggttgatgtcagctgcaattaaagatcagaaagctgtgcatgctgacatgggttattggatagagagctcaaaaaaccagacctggcagatagagaaagcatcacttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaagattgtgaccataggggcccatctttgagaaccaccactgcatctggaaaactagtcacgcaatggtgttgccgctcctgtacgatgccccccttaaggttcttgggagaagatggatgctggtatgggatggagattaggcccttgagtgaaaaagaagagaacatggtcaagtcacaggtggcggccggacagggcacatcagaaactttttctatgggtctgttgtgcctgaccttgtttgtggaagaatgcttgaggagaagggtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtcgtcacactcattcctttgtgcaggacaagctgtcttcaaaaacagtctcattgggtcgaaataacagcactcatcctaggcgcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctgtaccccttggcaatcccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggtcggagtagggatacatatggaaggtgtatttcacacaatgtggcatgttacaagaggatcagtgatttgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtggtcaccaaatcaggtgattacgtcagtgccataacgcaagccgaaagaattggagagccagattatgaagtggatgaggatatttttcgaaagaaaagattaactataatggacttacaccccggagctggaaagacaaaaagaattcttccatcaatagtgagagaagccttaaaaaggaggctgcgaactttgattctggctcccacgagagtggtggcggccgagatggaagaggccctacgtggactgccaatccgttaccagaccccagctgtgaaatcagaacacacaggaagagagattgtagaccttatgtgtcatgcaaccttcacaacaagacttttgtcctcaaccagggttccaaattacaaccttatagtgatggatgaagcacatttcaccgatccttccagtgtcgcggctaggggatacatttcgaccagggtggaaatgggagaggcagcagccatcttcatgaccgcaacccctcccggagcgacagatccctttccccagagcaacagcccaatagaagacattgagagagagattccggaaaggtcatggaacacagggttcgactggataacagactaccaagggaaaactgtgtggtttgttcccagcataaaagcgggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtgattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggaccggaaagggaaaaaacccaagccattgatggagagtttcgcctcagaggggaacaaaggaagacttttgtggaattaatgaggagaggagaccttccggtgtggctgagctataaggtggcatctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatatgctgaccccatggctttgaaggatttcaaggagtttgccagcggaaggaagagtataactctcgacatcctaacagagattgccagcttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggcatcttcctgtttttcatgcaagggaaaggaatagggaaattgtcaatgggtttgataaccattgcggtggctagtggcttgctttgggtagcagaaattcaaccccagtggatcgcggcctcaatcatactggagttttttctcatggtactgttgataccagaaccagaaaaacaaaggaccccacaagacaatcaattgatctacgtcatattggccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccattgccaaccaggcagccgtcctaatggggcttggaaaaggatggccgctgcacagaatggacctcggtgtgccgctattagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaagcaattagggcaggtcatgctactagtcttatgtgctggacaactactcttgatgagaacaacctgggctttctgtgaagtcttgactttggccacaggaccaatcttgaccttgtgggagggcaacccgggaaggttttggaacacgaccatagctgtatccaccgccaacattttcaggggaagttacttagcgggagctggactggctttttcactcataaagaatgcacaaacccctaggaggggaactgggaccacaggagagacactgggagagaagtggaagagacagctaaactcattagacaggaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacgctcaagaacgtgactgaagttaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctcgatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctcctcggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgagcaatctggtacatgtggctcggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatccttgccaaagccattttcaaactaacctatcaaaacaaagtggtgaaagtcctcagacccacaccgagaggagcggtgatggatatcatatccaggaaagaccaaagaggtagcggacaagtaggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccatcactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgctcatgtacttccacagaagggatctgcgtttagcctccatggccatctgctcagcagttccaacggaatggtttccaacaagcagaacaacatggtcaatccatgctcatcaccaatggatgaccactgaagacatgctcaaagtgtggaacagagtgtggatagaagacaaccccaatatgattgacaagactccagtccattcgtgggaagatataccttacctggggaaaagagaggatttgtggtgtggatccctgattggactttcgtctagagccacctgggcgaagaacattcacacggccataactcaggtcaggaaccttatcggaaaagaggaatacgtggattacatgccagtaatgaaaagatacagtgctccttcagagagtgaaggagttctgtaa

SEQ ID NO: 7893 - RNA, 9867 nt, synthetic construct
  misc_feature 1..9867: note = derived and/or modified CDS sequence (wt) from DENV-4__JQ513338__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaataaatgcactctcattgccatggacttgggtgaaatgtgtgaggacactgtcacgtataaatgccccctactggtcaataccgaacctgaagacattgattgttggtgcaacctcacgtctacctgggtcatgtatgggacatgcacccagagcggagaacggagacgagagaagcgctcagtagctttaacaccacattcaggaatgggattggagacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctcgtcgccccatcctacggaatgcgatgcgtaggagtaggaaacagagattttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggagcaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggaaacacccctgcagtaggaaatgacacatccaatcatggggttacagccccgataactcccaggtcaccatcggttgaagtcaaactgccggactatggagaactaacactcgattgtgaacccaggtctggaattgacttcaatgagatgattctaatgaaaatgaaaaagaaaacatggctcgtgcataagcaatggtttttggatctgcctcttccatggacaacaggagctgatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatgaaaatcacatgtttgcaggacatctcaagtgcaaagtccgcatggggaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaacaccaatagtgtaaccaacatagaattagaacccccctttggggacaggtacatagtgataggtgttggaaacagcgcactaacactccattggttcaggaaagggagttccattggcaagatgtttgaatccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaattctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcctctgcaatattaaatgcccacaaagatggggtctgtggaattagatcaaccacgaggctggaaaatgttatgtggaaacaaataaccaatgagctaaactatgttctctgggaaggaggacatgatctcactgtcgtggctggggatgtgaaaggggtgttgaccaaggggaagagagcactcacacccccagcgagtgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactacggatttggcatgttcacgaccaacatatggatgaaattccgagaaggaagttcagaagtgtgtgatcacaggttaatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggcccatggcacttgggcaaactagagatagactttggagaatgccccggaacaacagttacaattcaggagaattgtgatcatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactgattttgctaaaaatagtaacacagtttgacaacacccaagtgggaaccttagctctttccttaactttcataagatcaacaatgtcattggtcatggcttggaggaccattatggctgtgttgtttgtggtcacactcattcctttgtgcaggacaagctgtcttcaaaaacagtctcattgggtagaaataacagcacttatcctaggagcccaagctctgccagtgtacctaatgactcttatgaaaggagcctcaagaagatcttggcctcttaacgaaggcataatggctgtgggtttggttagtctcttaggaagtgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtcaaaacacaaagatcaggagccctgtgggacgtcccttcacccgctgccactcaaaaagccgcactgtccgaaggagtgtacaggatcatgcaaagagggttattcgggaaaactcaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagattttaaacccggaacgtctggttcccccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactcccaatccgttaccaaaccccagctgtgaaatcagaacacacaggaagagagattgtagacctcatgtgccatgcaaccttcacaacaagacttttgtcatcaaccagagttccaaactacaaccttattgtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcggggaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcctatcccagtgactccagcaagcgctgcccagagaagagggcgaataggaaggaatccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagacctcccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttgctaggtgctatgacagcaggtatcttcctgtttttcatgcaagggaaaggaatagggaaattgtcaatgggtttgataaccattgcggtggctagtggcttgctctgggtggcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtgcattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtgttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcaggtggattgttgagagagggatggtaaagccaaaagggaaagttatagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggagggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtcgatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagatacaaccccttttgggcaacaaagagtgttcaaagagaaggtcgataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagcgagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctaggagcgcggtttctggaatttgaagccctgggttttttgaacgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttaaaagaaagagttgagaaatggctgagagagtgtggtgtcgacaggttaaagaggatggcaataagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcgcagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtgcattcgtgggaagatataccttacctagggaaaagagaggatttgtggtgtggatccctgattggactttcttctagagccacctgggcgaagaacattcacacggccataacacaggtcaggaatctgatcggaaaagaggaatacgtggattacatgccagtaatgaaaagatatagtgctccttcagagagtgaaggagttctgtaa

SEQ ID NO: 7894 - RNA, 9867 nt, synthetic construct
  misc_feature 1..9867: note = derived and/or modified CDS sequence (wt) from DENV-4__JQ513339__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaataaatgcactctcattgccatggacttgggtgaaatgtgtgaggacactgtcacgtataaatgccccctactggtcaataccgaacctgaagacattgattgttggtgcaacctcacgtctacctgggtcatgtatgggacatgcacccagagcggagaacggagacgagagaagcgctcagtagctttaacaccacattcaggaatgggattggagacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctcgtcgccccatcctacggaatgcgatgcgtaggagtaggaaacagagattttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacggtccacaatggagacacccatgcagtaggaaatgacacatccaatcatggggttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacgacaggagcagatacatcagaggttcactggaattacaaagagagaatggcgacctttaaggttcctcatgccaagagacaggatgtgacactgctgggatctcaggaaggagccatgcattctgccctcgctggagccacagaagtggactccggtgatgaaaatcacatgtttgcaggacatctcaagtgcaaagtccgcatggggaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttctctcagccacccctttggctgagaacaccaatagtgtaaccaacatagaattagaacccccctttggggacagctacatagtgataggtgttggaaacagcgcactaacactccattggttcacgaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcctctgcaatattaaatgcccacaaagatggggtctgtggaattagatcaaccacgaggctggaaaatgttatgtggaaacaaataaccaatgagctaaactatgttctctgggaaggaggacatgatctcactgtcgtggctggggatgtgaaaggggtgttgaccaaggggaagagagcactcacacccccagcgagtgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactacggatttggcatgttcacgaccaacatatggatgaaattccgagaaggaagttcagaagtgtgtgatcacaggttaatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggcccatggcacttgggcaaactagagatagactttggagaatgccccggaacaacagttacaattcaggagaattgtgatcatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactgattttgctaaaaatagtaacacagtttgacaacacccaagtgggaaccttagctctttccttaactttcataagatcaacaatgtcattggtcatggcttggaggaccattatggctgtgttgtttgtggtcacactcattcctttgtgcaggacaagctgtcttcaaaaacagtctcattgggtagaaataacagcacttatcctaggagcccaagctctgccagtgtacctaatgactcttatgaaaggagcctcaagaagatcttggcctcttaacgaaggcataatggctgtgggtttggttagtctcttaggaagtgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtcaaaacacaaagatcaggagccctgtgggacgtcccttcacccgctgccactcaaaaagccgcactgtccgaaggagtgtacaggatcatgcaaagagggttattcgggaaaactcaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagattttaaacccggaacgtctggttcccccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactcccaatccgttaccaaaccccagctgtgaaatcagaacacacaggaagagagattgtagacctcatgtgccatgcaaccttcacaacaagacttttgtcatcaaccagagttccaaactacaaccttattgtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcggggaagaaagttatccagttgagtaggaaaacctttgatacagaatatccaaaaacgaagctcacggactgggactttgtggtcactacagacatatctgaaatgggggctaactttagagctgggagagtgatagaccctagaagatgcctcaagccagttatcctaacagatgggccagagagagtcatcttagcaggtcctatcccagtgactccagcaagcgctgcccagagaagagggcgaataggaaggaatccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagacctcccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttgctaggtgctatgacagcaggtatcttcctgtttttcatgcaagggaaaggaatagggaaattgtcaatgggtttgataaccattgcggtggctagtggcttgctctgggtggcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtgcattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtgttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcaggtggattgttgagagagggatggtaaagccaaaagggaaagttatagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggagggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtcgatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagatacaaccccttttgggcaacaaagagtgttcaaagagaaggtcgataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagcgagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctaggagcgcggtttctggaatttgaagccctgggttttttgaacgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttaaaagaaagagttgagaaatggctgagagagtgtggtgtcgacaggttaaagaggatggcaataagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcgcagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtgcattcgtgggaagatataccttacctagggaaaagagaggatttgtggtgtggatccctgattggactttcttctagagccacctgggcgaagaacattcacacggccataacacaggtcaggaatctgatcggaaaagaggaatacgtggattacatgccagtaatgaaaagatatagtgctccttcagagagtgaaggagttctgtaa

SEQ ID NO: 7895 - RNA, 9867 nt, synthetic construct
  misc_feature 1..9867: note = derived and/or modified CDS sequence (wt) from DENV-4__JQ513343__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaataaatgcactctcattgccatggacttgggtgaaatgtgtgaggacactgtcacgtataaatgccccctactggtcaataccgaacctgaagacattgattgctggtgcaacctcacgtctacctgggtgatgtatgggacatgcacccagagcggagaacggagacgagagaagcgctcagtagctttaacaccacattcaggaatgggattggagacaagagctgagacatggatgtcatcggagggggcttggaagcatgctcagagagtagagagctggatactcagaaacccaggatttgcactcttggcaggatttatggcttatatgattgggcaaacagggatccagcgaactgtcttctttgtcctaatgatgcttgtcgccccatcctacggaatgcgatgcgtaggagtaggaaacagagactttgtggaaggagtgtcaggtggagcatgggttgacctggtgctagaacatggaggatgcgtcacaaccatggcccagggaaaaccaaccttggattttgaactgaccaagacaacagccaaggaagtggctctgttaagaacctattgcattgaagccttaatatctaacataactacggcaacaagatgtccaacgcaaggagagccttatctcaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggagttacagccacgataactcccaggtcaccatcggtcgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggagacctttaaggttcctcatgccaagagacaggatgtgacactgctgggatctcaggaaggagccatgcattctgccctggctggagccacagaagtggactccggtgatgaaaatcacatgtttgcaggacatctcaagtgcaaagtccgtatggaaaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagcgacccctttggctgagaataccaatagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgtcggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcttctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggaaagagagcactcacacccccagcgagtgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatttggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctctgattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtcggcccatggcacttgggcaaactagagatagactttggagaatgccccggaacaacagttacaattcaggagaattgtgatcatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtgaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactgacttcaagagagacagcactaatggtaataggaatggccatgacaacaacactttcaattccacatgacctcatggaactcattgatggaatatcactaggactgattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcacttatcctgggagcccaagctctgccagtgtacctaatgactcttatgaaaggagcctcaagaagatcttggcctcttaacgaaggcataatggctgtgggtttggttagtctcttaggaagtgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctgtaccccttggcaattccaatcacaatgaccttatggtacatgtggcaagtgaaaacacaaagatcaggagccctgtgggacgtcccttcacccgctgccactcaaaaagccgcactgtccgaaggagtgtacaggatcatgcaaagagggttattcgggaaaactcaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagattttaaacccggaacgtctggttcccccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctccgtggacttccaatccgttaccaaaccccagctgtgaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcggggaagaaagtcatccagttgagtaggaaaacctttgatacagaatatccaaaaacgaagctcacggactgggactttgtggtcactacagacatatctgaaatgggggctaactttagagctgggagggtgatagaccctagaagatgcctcaagccagttatcctaacagatgggccagagagagtcatcttagcaggtcctatcccagtgactccagcaagcgctgcccagagaagagggcgaataggaaggaacccagcacaagaagacgaccaatacgttttctccggagacccactaaaaaatgatgaagatcatgcccactggacagaagcaaagatgctccttgacaatatctacaccccagaagggatcattccaacattgtttggtccggaaagggaaaaaacccaagctattgatggagagtttcgcctcagaggggaacaaaggaagacttttgtcgaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactcaggccaaaatggttagatgcacgtgtatacgctgaccccatggctttgaaggatttcaaggagtttgccagtggaaggaagagtataactctcgacatcctaacagagatcgccagtttgccaacctacctttcctctagggccaagctcgcccttgacaacatagttatgctccacacaacagaaagaggagggagggcctatcaacacgccctgaacgaacttccggagtcactggaaacactcatgcttgtagccttgctaggtgctatgacagcaggtatcttcctgtttttcatgcaagggaaaggaatagggaaattgtcaatgggtttgataaccattgcggtggctagtggcttgctctgggtggcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggctcggaaaaggatggccactccacagaatggacctcggtgtcccgctgttagcaatgggatgctattctcaagtgaacccaacaaccttgacagcatccttagtcatgcttttagtgcattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccacaggagagacactgggagagaagtggaagagacagctaaactcattggacagaaaagagtttgaagagtataaaagaagtggaatactagaagtggacaggactgaagccaagtctgccctgaaagatgggtccaaaatcaagcatgcagtatctagagggtccagtaagatcaggtggattgttgagagagggatggtaaagccaaaagggaaagttatagatcttggctgtgggaggggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaagagggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcctcctccatggtgaacggggtggtgaaactgctaacaaaaccctgggatgtaattccaatggtgactcagttagccatgacagatacaaccccttttgggcaacaaagagtcttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccatcggcgcagtctttcaagaggaacagggatggacatcagccagtgaagctgtgaatgacagccggttttgggaactggtcgacaaagaaagggcccttcaccaagaagggaaatgtgaatcgtgtgtctataacatgatgggaaaacgtgagaaaaagttaggagagtttggcagagccaagggaagccgagcaatctggtatatgtggctaggagcgcggtttctggaatttgaagccctgggttttttgaacgaagatcattggtttggcagagaaaactcatggagtggggtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttaaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggtccctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcgcagatgtggtcgcttatgtacttccacagaagggatctgcgtttagcctccatggccatatgctcagcagtcccaacggaatggtttccaacaagcagaacaacatggtcaatccatgctcatcaccaatggatgaccactgaagatatgctcaaggtgtggaacagagtgtggatagaagacaaccccaatatgattgacaagactccagtgcattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttctgagagtgaaggagttctgtaa

SEQ ID NO: 7896 - RNA, 9867 nt, synthetic construct
  misc_feature 1..9867: note = derived and/or modified CDS sequence (wt) from DENV-4__KT276273__SS-prME
  source 1..9867: mol_type = other RNA
tcaacgataacattgttgtgcttgattcccaccgtgatggcgtttcacttgtcaacaagagatggcgaacccctcatgatagtggcaaaacatgaaagggggagacctctcttgtttaagacaacagaggggatcaacaaatgcactctcattgctatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtccttatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaagaccaaccttggattttgaactgactaagacaacagctaaggaagtggctctgttaagaacctattgtattgaagcctcaatatcaaacataaccacggcaacaagatgtccaacgcaaggagagccttatctgaaagaggaacaggatcaacagtacatctgccggagagatgtggtagacagaggatggggtaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtagggaatgacacatctaatcatggagttacagccacgataactcccaggtcaccatcggtagaagtcgaactgccggactatggagaactaacactcgattgtgaacctaggtctggaattgactttaatgagatgatcctaatgaaaatgaacaagaaaacatggcttgtgcataagcaatggtttttggatctacctcttccatggacagcaggagcagacacatcagaggttcactggaataacaaagagagaatggtgacatttaaggttcctcatgctaagagacaggatgtgacagtgctgggatctcaggaaggagctatgcattcagccctcgctggagccacagaagtggactccggtgatggaaatcacatgtttgcaggacatctcaagtgcaaagtccgtatggagaaattgagaatcaaaggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtgattgggcgcgttatctcatctatccctttggctgagaataccaacagtgtgaccaacatagaattagaacccccctttggggacagctacatagtgataggtgttggaaacagcgcattaacactccattggtttaggaaagggagttccattggcaagatgttcgagtccacatacagaggtgcaaaacgaatggccattctaggtgagacggcttgggattttggttctgttggtggactgttcacatcattgggaaaggctgtgcaccaggtttttggaagtgtgtacacaaccatgtttggaggagtctcatggatgattagaatcttaattgggttcttagtgttgtggattggcacgaactcaaggaacacttcaatggccatgacgtgcatagctgtcggaggaatcactctgttcttgggcttcacagttcaagcggacatgggttgtgtggtgtcatggagtgggagagagttgaaatgtggaagcggaatttttgtgattgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatcttactgtagtggctggggatgtgaagggggtgttgaccaaaggcaagagagcactcacacccccagcaagtgatctgaaatattcatggaagacatggggaaaagcaaaaatcttcacccctgaagcaagaaacagcacatttttaatagacggacccgatacctctgaatgccccaatgaacgaagagcatggaattctcttgaggtggaagactatggatttggcatgttcacgaccaacatatggatgaaattccgagaaggaagttcagaaatgtgtgaccataggttaatgtcagctgcaattaaagatcagaaagctgtgcatgctgatatgggttattggatagagagctcaaaaaaccagacctggcagatagagaaagcatctcttattgaagtgaaaacatgtctatggcccaagactcacacactgtggagcaatggagtgctggaaagccagatgctcattccaaaatcatatgcgggccctttttcacagcacaactaccgtcagggctatgccacgcaaatcgcaggcccatggcacttaggcaaactagagatagactttggagaatgccccggaacaacagtcacaattcaggaggattgtgaccacagaggcccatctttgaggaccaccactgcatctggaaagttagtcacgcaatggtgttgccgctcctgcacgatgccccccttaaggttcttgggagaagatgggtgctggtatgggatggagattaggcccttgagtgaaaaagaagagaatatggtcaaatcacaggtggcggccggacagggcacatcagaaactttttctatgggtctgttgtgcctgaccttgtttgtggaagaatgcttgaggagaagagtcactaggaaacacatgatattagttgtggtgatcactttttgtgctatcatcctgggaggcctcacatggatggacttactacgagccctcatcatgttgggggacactatgtctggtagaataggaggacagatccacttagccatcatggcagtgttcaagatgtcaccaggatacgtgctaggtgtgtttttaaggaaactcacttcaagagagacagcactaatggtaataggaatggccatgacaacggtactttcaattccatatgaccttatggaactcattgatggaatatcactaggactaattctgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcattctaggagcccaagctctgccagtgtacctaatgactcttatgaaaggagcctcaagaagatcttggcctctcaacgagggcataatggctgtgggtctggttagtctcttaggaagcgctcttttgaagaatgatgtccctttagcaggcccaatggtagcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgagacgtcgaggaaaccaatatgataacccttttggtgaagctggcattgataacagtgtcaggtctctaccccttggcaattccagtcacaatgaccctatggtatatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacatatggaaggtgtgttccacacaatgtggcatgttacaagaggatcagtgatctgccatgagactgggagattggagccatcttgggctgacgtcaggaatgacatgatatcatacggtgggggatggaggcttggagacaaatgggacaaagaagaagacgttcaggttctcgctatagaaccagggaaaaatcccaaacatgtccaaacgaaaccaggccttttcaagaccctaactggagaaattggagcagtaacattagatttcaaacccggaacgtctggttctcccatcatcaacaggaaaggaaaagtcatcggactctatggaaatggagtggtcaccaaatcaggtgattacgttagtgctataacgcaagccgaaagaattggagagccagattatgaagtggatgaggacatttttcggaagaaaagattaactataatggacttacaccccggagctggaaagacgaaaagaattcttccatcaatagtgagagaagccctaaaaagaaggctgcgaactttgattctggctcccacgagagtggtggcggccgaaatggaagaggccctacgtggactgccaatccgttaccagaccccagctgtgaaatcagaacacacaggaagagagattgtagacctcatgtgtcatgcaaccttcacaacaagacttttgtcatcaactagggttccaaattacaacctcatagtaatggacgaggcacatttcaccgatccttccagtgtcgcggctagaggatacatttcgaccagggtggaaatgggagaagcggcagccatcttcatgaccgcaaccccccccggagcgacagatccctttccccagagcaacagcccaatagaagacatcgagagagagattccggaaaggtcatggaacacagggtttgattggataacagactatcaagggaaaactgtgtggtttgttcccagcataaaagctggaaatgatattgcaaattgtttgagaaagtcgggaaagaaagtcattcagttgagtaggaaaacctttgacacagaatatccgaaaacgaaactcacggactgggactttgtggtcactacagacatatctgaaatgggggctaactttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccattaaaaaatgatgaagatcatgcccactggacagaagcaaagatgctgcttgacaatatctacaccccagaagggatcattccaacactgtttggtccggaaagggaaaaaacccaagccattgatggagagtttcgtctcagaggggaacaaaggaagacttttgtggaattgatgaggagaggagaccttccagtgtggctgagctataaggtagcatctgctggcatttcttacaaagatcgggaatggtgcttcactggggaaagaaacaatcaaattttagaagaaaacatggaggttgaaatttggactagagagggggaaaagaaaaaactgaggccaagatggttagatgcacgtgtatatgctgaccccatggctttgaaggatttcaaggagtttgccagtggaaggaagagtattactctcgacattctaacagagattgccagtttgccaacttatctttcctctagggccaagctcgcccttgataacatagtcatgctccacacaacagaaagaggagggagggcctatcaacatgccctgaacgaacttccggagtcactggaaacactcatgcttgtagccttactaggtgctatgacagcaggcatcttcctgtttttcatgcaagggaaaggaatagggaaattgtcaatgggtttgataaccattgcggtggctagtggcttgctctgggtagcagaaatccaacctcagtggatagcggcctcaatcatactggaattttttctcatggtactgttgataccagaaccagaaaaacaaaggaccccacaagacaatcaattgatctacgtcatattgaccattctcaccattataggtctaatagcagccaacgagatggggctgatagaaaaaacaaaaacggattttgggttttaccaggtaaagacagaaaccaccatcctcgatgtggatttgagaccagcttcggcatggacgctctatgcagtagccaccacaattctgactcccatgctgagacacaccatagaaaacacatcggccaacctatctttagcagccattgccaaccaggcagccgtcctaatggggcttggaaaaggatggccgctccacagaatggacctcggtgtgccgctgctggcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagagccaatatcctatgacccaaaatttgaaaagcaattagggcaggtcatgctactagtcctgtgtgctggacaactactcctgatgagaacaacatgggctttctgtgaagtcttgactttggccacaggaccaatcttgaccttgtgggagggcaacccgggaaggttttggaacacgaccatagccgtatccacagccaacattttcaggggaagttacttagcgggagctggactggctttttcactcataaagaatgcacaaacccctaggaggggaactgggaccacaggagagacactgggagagaagtggaagagacagctaaactcattagacagaaaagagtttgaagaatataaaagaagtggaatactggaagtggacaggactgaagctaagtctgccctgaaagatgggtctaaaatcaagcatgcagtgtctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgatacctatggctacttatggctggaatttggtcaaactccattcaggggttgacgtgttctataaacccacagagcaagtggacaccctgctctgtgatattggggagtcatcttctaatccaacaatagaggaaggaagaacattaagagttctgaagatggtggagccatggctctcttcaaaacctgaattctgcataaaagtccttaacccctacatgccaacagtcatagaagagctagagaaactgcagaggaaacatggtgggaaccttgtcagatgcccgctgtccaggaactccacccatgagatgtattgggtgtcaggagcgtcgggaaacattgtgagctctgtgaacacaacatcaaagatgttgttgaacagattcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtaccatggaagctatgaagctccttcgacaggctctgcatcctctatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggtcatgaccacgacagccaattggctatgggccctccttggaaagaagaagaatcccagactgtgcacaaaggaagagttcatctcaaaagttagagcaaacgcagccataggcgcagtctttcaggaagaacagggatggacatcagccagtgaagctgtgaatgacagccggttttgggagctggttgacaaagaaagggcccttcaccaggaagggaaatgtgaatcgtgtgtctacaacatgatgggaaaacgtgagaaaaagttaggagagtttggcagagccaagggaagccgagcaatctggtacatgtggctgggagctcgttttctggaatttgaagccctgggttttttgaatgaagaccactggtttggcagagaaaattcatggagtggagtggaaggggaaggtctgcacagattgggatacatcctggaggagatagacaagaaggatggagacctaatgtatgctgacgatacagcaggctgggacacaagaatcactgaggatgaccttcaaaatgaggaactgatcacggaacagatggctccccaccataagatcctagccaaagctattttcaaactaacctatcaaaacaaagtggtgaaagtcctcagacccacaccgagaggagcggtgatggacatcatatccaggaaagaccaaagaggtagtggacaagttggaacatatggtttgaacacattcaccaacatggaagtccaactcatccgccaaatggaagctgaaggagtcatcacacaagatgacatgcagaacccaaaagggttgaaagaaagggttgagaaatggctgagagagtgtggtgtcgacaggttaaaaaggatggcaatcagtggagacgattgcgtggtgaagcccctagatgagagatttgccacttccctcctcttcttgaacgacatgggaaaggtgaggaaagacataccgcagtgggaaccatctaagggatggaaaaactggcaagaggttcctttttgctcccaccactttcacaagatctttatgaaggatggccgctcactagtagttccatgtagaaaccaggatgaactgatagggagagctagaatctcgcagggggctggatggagcttgaaagaaacagcctgcctggccaaagcttacgcccagatgtggtcgcttatgtacttccacagaagggatctgcgtttggcctccatggccatatgctcagcagttccaacggaatggtttccaacaagcagaacaacatggtcaatccacgctcatcaccaatggatgaccactgaagacatgctcaaagtgtggaacagagtgtggatagaggacaaccccaatatgattgacaagactccagtccattcgtgggaagacataccttacctagggaaaagagaggatttatggtgtggatccttgattggactttcttctagagccacctgggcgaagaacattcacacggccataactcaggtcaggaacctgatcggaaaagaggaatacatggattacatgccagtaatgagaagatacagtgctccttcagagagtgaaggagttctgtaa

SEQ ID NO: 7897 - RNA, 9867 nt, synthetic construct
  misc_feature 1..9867: note = derived and/or modified CDS sequence (wt) from DENV-4__KU523872__SS-prME
  source 1..9867: mol_type = other RNA
tcaacaatgacattgctgtgtttgattcccaccgtaatggcgtttcacctgtcaacaagagacggcgaacccctcatgatagtggcaaaacacgaaagggggagacctctcttgtttaagacaacagaaggaatcaacaaatgcaccctcattgccatggacctgggtgaaatgtgtgaagacactgtcacgtataaatgtcctctactggttaacaccgaacctgaagacattgattgctggtgtaatctcacgtccacctgggtcatgtacgggacatgcacccagagcggagaacggaggcgagagaagcgctcagtagctttaacaccacattcaggaatgggattggaaacaagagctgagacatggatgtcatcggaaggggcttggaaacatgctcagagagtggaaagctggatactcagaaacccaggattcgcgctcctggcaggatttatggctcacatgattgggcaaacaggaatccagcgaactgttttctttgtcctaatgatgctagtcgccccatcctacggaatgcgatgcgtaggggtagggaacagagactttgtggaaggagtctcaggtggagcgtgggtcgacttggtgctagaacatggaggatgcgtcacaactatggcccagggaaaaccaaccttggattttgaactgaccaagacaacagctaaggaagtggctctgttaagaacctattgcattgaagcttcgatatcaaacataaccacggcaacaagatgtccaacgcaaggagagccttatctcaaagaggaacaagaccaacagtacatttgccggagagatgtggtagatagagggtggggcaatggctgtggcttgtttggaaaaggaggagttgtgacatgtgcgaagttttcatgttcggggaagataacaggcaatctggtccaaattgaaaaccttgaatatacggtagttgtgacagtccacaatggagacacccatgcagtaggaaatgacacatccaatcatggagtgacagccacgataactcccaggtcaccatcggtagaagtcaaattgccggactatggagaactaacactcgattgtgaacccaggtccggaattgacttcaatgagatgatcctgatgaaaatgaaaaagaaaacgtggcttgtgcacaagcaatggtttttggacctacctctaccatggacagcaggagcagacacatcagaagttcattggaattataaagagagaatggtgacattcaaagttcctcacgccaagagacaggatgtgacagtgctaggatctcaggagggagctatgcattctgccctcgccggagccacagaagtggattctggtgatggaaatcacatgtttgcaggacatctcaagtgcaaagtccgtatggagaaattgagaattaagggaatgtcatacacgatgtgttcaggaaagttctcaattgacaaagagatggcagaaacacagcatgggacaacagtggtgaaagtcaaatacgaaggcgctggagctccgtgtaaagtccccatagagataagagatgtgaacaaggaaaaagtagttgggcgcatcatctcatctaccccctttgctgagaataccaacagtgtaaccaacatagaattggaacccccttttggggacagctacatagtgataggtgttggagatagtgcattaacactccattggttcaggaaagggagctccattggtaagatgtttgagtccacatacagaggtgcaaaacgaatggccattttaggtgaaacagcttgggattttggttctgttggtggactgttcacatcactgggaaaggctgtacaccaagtttttggaagtgtgtatacaaccatgtttggaggggtctcatggatgattagaatcctaattgggttcttagtactgtggattggcacgaattcaagaaatacttcaatggcaatgacgtgcatagctgttggagggatcactctgtttctaggtttcacagttcaagcagacatgggttgtgtggtgtcatggaatgggaaggaactaaaatgtggaaatggaatctttgtggttgacaacgtgcacacttggacagaacagtacaaattccaaccagagtccccagcgaggctagcgtctgcaatattgaatgcccacaaagatggggtctgtggaatcagatcaaccacgaggctggaaaatgttatgtggaagcaaataaccaacgagctaaactatgttctctgggaaggaggacacgacctcactgtagtggctggggacgtgaaaggggtgttgaccaaaggcaagagagcactcacacctccagtgaatgatctgaaatattcatggaagacatggggaaaagcaaaaatctttaccccagaagcaagaaatagcacgtttttaatagacggaccagacacctccgaatgccccaatgaacgaagagcatggaacttttttgaggtagaagactatggatttggcatgtttacgaccaacatatggatgaaattccgagaaggaagttcagaagtgtgtgaccataggttaatgtcagcggcaatcaaagatcagaaagctgtgcatgctgacatgggttattggatagagagctcaaaaaaccagacctggcaaatagagaaagcatcccttattgaagtgaaaacatgtctgtggcccaaaacccacacgctgtggagcaatggagtgctggaaagtcagatgctcattccaagatcatacgcaggccctttttcacagcacaattaccgccagggctatgccacgcaaaccgcgggcccatggcacttgggcaagttggagatagactttggagaatgtcccggaacaacagtcacaattcaggaggattgtgaccatagaggcccatctctgaggaccaccactgcatctggaaaactggtcacgcagtggtgctgccgctcctgcacgatgcctcccttaaggttcttgggagaagatggatgctggtacgggatggagattaggcccttgagtgaaaaagaagagaacatggtcaaatcacaggtaacagccggacagggtacatcagagactttttctatggggctgctatgcctgaccttgttcgtggaagaatgcttaaggagaagagtcactaggaaacacatgatattggttgtggtaatcaccttttgtgctatcatcctaggaggtctcacatgggtggatttactacgagcccttatcatgttaggggacaccatgtctggtagaataggaggacagattcacctagccatcatggcagtgttcaagatgtcaccaggatatgtgctgggtgtgtttttaaggaaactcacttcaagagagacagcgctgatggtaataggaatggccatgacaacggtgttttcaattccacatgacctcatggaactcattgatggaatatcattgggattgatattactaaaaatagtaacacactttgataacacccaagtgggaaccttagccctttccttgactttcataagatcaacaacaccattagtcatggcttggaggaccatcatggctgtgttctttgtggtcacactcattcctttgtgcaggacaagctgtcttcaaaaacagtcccattgggtagaaataacagcacttatcttaggagcccaggctttgccagtgtacctaatgactctcatgaaaggagcctcgagaagatcttggcctcttaatgagggcataatggctgtgggtttggtgagcctcttgggaagcgccctcttaaagaatgatgttcctttagctggcccaatggtggcaggaggcttacttctagcggcttacgtaatgagtggtagctcagcagacctgtcactagagaaggctgctaatgtgcaatgggatgaaatggcagacataactggctcaagcccagtcatagaagtgaagcaggatgaagatggctctttctccatacgagacgtcgaggaaaccaacatgataaccctcttggtgaaactggcgctgataacagtatcaggtctttaccccttggcaattccagtcacaatggcaatatggtatatttggcaagtgaaaacacaaagatcaggagctctgtgggacgtcccctcacccgctgccactcagaaagccacactgtctgaaggggtgtataggatcatgcaaagagggttgttcgggaaaactcaggttggagtagggatacacatggaaggtgtgttccacacaatgtggcacgtaacaagaggatcagtgatctgccatgagacagggagattagagccatcttgggctgacgtcaggaatgacatgatatcatacggtgggggatggaagctcggagacaaatgggacaaagaagaagatgttcaggtcctagccatagaaccaggaaaaaatccaaaacatgtccaaacgaaaccaggccttttcaagaccctaactggagaaattggagcagtaactctggatttcaaacccggaacatctggctctcctatcataaacaagaaagggaaagttattggactctatggaaatggagtagttaccaaatcaggtgattacgtcagtgccataacgcaagccgaaagaattggtgagccagattatgaagtggatgaggacatttttcgaaagaaaagattgactataatggacttacaccccggagccggaaagacaaaaagaattctcccgtcaatagtcagagaagctttgaaaaggaggctgcgaaccttgattctggcccccacgagagtggtggcggccgagatggaagaggccttacgcggactgccaatccgttatcagaccccagctgtgaaatcagagcacacaggaagagagattgtagacctcatgtgtcatgcaaccttcacaacgagacttttgtcatcaaccagggttccaaattataacctcatagtgatggatgaagcacattttactgacccttgtagtgtcgcagctagaggatacatttcaaccagggtggaaatgggagaggcagcagctatcttcatgactgcaacccctcctggatcgatagatcccttcccccagagcaacagcccaatagaagacatcgagagggaaatcccagaaaggtcatggaacacagggttcgactggataacagactaccaagggaaaactgtgtggtttgttcccagcataaaagctggaaatgacattgcaaattgtttgagaaagtcgggaaagagagtaatccagttgagcagaaaaacctttgacacagagtatccaaagacgaaactcacggactgggattttgtggtcaccacagacatatctgaaatgggagccaatttcagagctgggagagtgatagaccctaggagatgcctcaagccagttatcctaacagatgggccagagagagttattctagcaggtccaattccagtaactccagcaagtgccgctcagagaagagggcgaataggtaggaatccagcacaagaagatgatcaatatgttttctccggagacccactaaggaatgatgaagatcatgctcactggacagaagcaaagatgctgcttgacaatatctacactcctgaaggaataattccaacattgtttggtccggaaagggaaaaaacccaagccattgatggagagtttcgcctcagaggggaacaaaggaagacttttgtggaattgatgaggagaggagaccttccggtgtggctgagctacaaggtagcttctgccggtatatcttataaagaccgagaatggtgcttcacaggggaaaggaataaccaaattttagaagaaaacatggaggttgaaatctggactagagagggagaaaagaaaaagctaaggccaaaatggttagatgcacgtgtgtacgctgaccctatggctttgaaggatttcaaggagtttgccagtggaagaaagagcataactcttgacatcctaacagagattgccactttgccaacttacctttcctctaaggccaagctagcccttgacaacatagtcatgctccacacaacagaaaaaggggggagggcctaccaacacgccctgaacgaactcccggagtcactggaaacactcatgcttgtagccctactaggtgctatgacagccggtatcttcctgtttttcatgcaggggaaagggatagggaaattgtcaatgggtctgatagccatagctgtggctagtggcttgctctgggtagcagaaattcagccccagtggatagcagcttcaatcatactggagttttttcttatggtgctgttgataccagaaccagaaaaacagaggaccccacaagacaatcaattgatctacgttatattgaccattctcaccattattggtcttgtagcagccaatgagatggggctgattgaaaaaacaaaaacggactttgggttctaccaggtaaaaacagaaaccaccattctggatgtggatttgagaccagcctcagcgtggacactctatgcagtggccaccactattctgactcctatgctgagacacaccatagagaacacgtcagccaacctgtctctagcagccattgccaaccaagcagctgtcctaatgggacttggaaaaggatggccgctccacagaatggacctcggtgtgccgctgctagcaataggatgttattctcaagtgaacccaacaaccttgacagcatccctagtcatgcttttagttcattatgccataataggtccaggattgcaggcaaaagccacaagagaggcccagaaaaggacagccgctgggatcatgaaaaaccccactgtggacgggataacagtaatagatctagaaccaatatcctatgacccaaaatttgaaaagcaattagggcaagtcatgctactagtcctgtgtgttggacaattacttttgatgagaacaacatgggctctctgcgaagtattgactctggccacaggaccaatcatgaccttgtgggagggcaacccaggaaggttttggaatacaaccatagctgtatccacagccaacatttttagaggaagctacttggcgggagctggactagctttttcgctcataaagaatgcacaaactcctaggaggggaactgggaccacaggagagacactgggagagaagtggaagagacagctaaactctttagacagaaaggagtttgaagagtacaaaagaagtggaatactagaagtggataggactgaagccaagtctgccttaagagatggatccaaaaccaagcatgcggtgtccagagggtcaagtaaaatcagatggattgttgaaagaggaatgataaaaccaaaaggaaaggtcgtagatcttggttgcgggaggggaggatggtcctattatatggcgacactcaagaacgtgactgaagtgaaaggatatactaaaggaggtccaggacatgaagaaccaatccccatggctacttatggctggaacttggtcaaactccattcaggggttgatgtgttctacaaacccactgagcaggtggacaccctgctctgtgacattggggagtcatcctctaatccgacaatagaggaagggaaaacattgagagtcttgaagatggtggagccatggctctcttcaaaacctgagttttgcatcaaagtcctcaacccctacatgccgacagtaatagaagagctggagaaactgcagagaagacatggtggaagcctcgtcagatgcccgctatccaggaattctacccatgagatgtattgggtgtcaggtgcgtcgggaaacatcgtgagttctgtaaacacaatatcaaagatgttgttgaacaggttcacaacaaggtatagaaaacccacttatgagaaggacgtagatcttggggcgggaacgagaagtgtctccactgaaacagaaaaaccagacatgacaatcattgggagaaggcttcagagattgcgagaagagcataaagaaacctggcactatgaccaggaaaacccatacagaacctgggcgtatcatggaagctatgaagctccttcgacaggttcagcatcctccatggtgaacggggtagtaaaactgctgacaaaaccttgggatgtggttccaatggtgacccagttggccatgacagacacaaccccttttgggcaacaaagagtgttcaaggagaaggtggataccagaacaccacaaccaaaacccggcacacgaaagattatgaccacgacagccaattggttgtgggccctcctcgggaagaagaaaagtcccagactatgcacaagggaagagttcatctcaaaagttaggtcaaatgcagccataggcgcagtctttcaggaagaacagggatggacatcagccagtgaagctgtgaatgacagccggttctgggaactggttgacaaagaaagggctctgcatcaggaaggaagatgtgaatcgtgtgtctacaacatgatgggaaaacgtgagaaaaaattaggagagtttggtagggccaagggaagccgagcaatctggtacatgtggctgggggcgcggttcctggaatttgaagccctgggttttttgaatgaagaccattggtttagcagagaaaactcatggagtggagtggaaggggaaggtctgcacagattgggatacatcttggaggacatagacaagaaggatggagacctgatatatgctgacgacacagcaggctgggacacgagaatcactgaagatgatcttttaaatgaagaactgatcacagaacagatggcccctcaccacaagactctagccaaagccattttcaaactaacctatcaaaacaaagtggtgaaagttctcagacccacaccgaaaggagcggtaatggacatcatatccagaaaagaccaaagaggtagtggacaggttggaacatatggtttaaacacattcactaacatggaagtccaactcatccgccaaatggaagctgaaggagtcatcacacaagacgacatgcagaacccagaagggttgaaagaaagagttgagaaatggctgaaagagtgtggcgtcgacaggttgaagaggatggcaatcagtggagatgattgcgtggtgaagcccctagatgagaggtttagcacctccctcctcttcttgaatgacatgggaaaggtgaggaaagacatcccgcagtgggaaccatccaagggatggaaaaactggcaagaggttcctttttgctcccaccatttccacaagatcttcatgaaagatggccgctcactggttgttccatgcagaaaccaggatgaactgataggaagagccagaatctcgcagggggctggatggagcttgagagaaacagcctgtctgggcaaagcttacgcccagatgtggtcgcttatgtatttccatagaagggacctgcgcctagcctccatggccatatgctcagcagttccaacagaatggtttccaacaagcagaacaacatggtcaatccacgcccatcaccagtggatgaccactgaagatatgcttaaagtgtggaacagagtgtggatagaagataaccccaatatgactgacaagactccagtccattcgtgggaagacataccttacctagggaaaagagaggatttgtggtgtggatccctgattggactttcttccagagccacctgggcgaagaacattcacacggccataacccaggtcagaaatttgatcggaaaagaggaatacgtggattacatgccagccatgaaaagatacagtgctccttttgagagtgaaggagttttgtaa

SEQ ID NO: 7898 - RNA, 9867 nt, synthetic construct
  misc_feature 1..9867: note = derived and/or modified CDS sequence (wt) from DENV-4__KP140942__SS-prME
  source 1..9867: mol_type = other RNA
tcaacgataacattgttgtgcttgattcccaccgtgatggcgtttcacttgtcaacaagagatggcgaacccctcatgatagtggcaaaacatgaaagggggagacctctcttgtttaagacaacagaggggatcaacaaatgcactctcattgctatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtccttatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaagaccaaccttggattttgaactgactaagacaacagctaaggaagtggctctgttaagaacctattgtattgaagcctcaatatcaaacataactacggcaacaagatgtccaacgcaaggagagccttatctgaaagaggaacaggatcaacagtacatctgccggagagatgtggtagacagaggatggggtaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtagggaatgacacatctaatcatggagttacagccacgataactcccaggtcaccatcggtagaagtcgaactgccggactatggagaactaacactcgattgtgaacctaggtctggaattgactttaatgagatgatcctaatgaaaatgaacaagaaaacatggcttgtgcataagcaatggtttttggatctacctcttccatggacagcaggagcagacacatcagaggttcactggaataacaaagagagaatggtgacatttaaggttcctcatgctaagagacaggatgtgacagtgctgggatctcaggaaggagctatgcattcagccctcgctggagccacagaagtggactccggtgatggaaatcacatgtttgcaggacatctcaagtgcaaagtccgtatggagaaattgagaatcaaaggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtgattgggcgcgttatctcatctatccctttggctgagaataccaacagtgtgaccaacatagaattagaacccccctttggggacagctacatagtgataggtgttggaaacagcgcattaacactccattggtttaggaaagggagttccattggcaagatgttcgagtccacatacagaggtgcaaaacgaatggccattctaggtgagacggcttgggattttggttctgttggtggactgttcacatcattgggaaaggctgtgcaccaggtttttggaagtgtgtacacaaccatgtttggaggagtctcatggatgattagaatcttaattgggttcttagtgttgtggattggcacgaactcaaggaacacttcaatggccatgacgtgcatagctgtcggaggaatcactctgttcttgggcttcacagttcaagcggacatgggttgtgtggtgtcatggagtgggagagagttgaaatgtggaagcggaatttttgtgattgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatcttactgtagtggctggggatgtgaagggggtgttgaccaaaggcaagagagcactcacacccccagcaagtgatctgaaatattcatggaagacatggggaaaagcaaaaatcttcacccctgaagcaagaaacagcacatttttaatagacggacccgatacctctgaatgccccaatgaacgaagagcatggaattctcttgaggtggaagactatggatttggcatgttcacgaccaacatatggatgaaattccgagaaggaagttcagaaatgtgtgaccataggttaatgtcagctgcaattaaagatcagaaagctgtgcatgctgatatgggttattggatagagagctcaaaaaaccagacctggcagatagagaaagcatctcttattgaagtgaaaacatgtctatggcccaagactcacacactgtggagcaatggagtgctggaaagccagatgctcattccaaaatcatatgcgggccctttttcacagcacaactaccgtcagggctatgccacgcaaatcgcaggcccatggcacttaggcaaactagagatagactttggagaatgccccggaacaacagtcacaattcaggaggattgtgaccacagaggcccatctttgaggaccaccactgcatctggaaagttagtcacgcaatggtgttgccgctcctgcacgatgccccccttaaggttcttgggagaagatgggtgctggtatgggatggagattaggcccttgagtgaaaaagaagagaatatggtcaaatcacaggtggcggccggacagggcacatcagagactttttctatgggtctgttgtgcctgaccttgtttgtggaagaatgcttgaggagaagagtcactaggaagcacatgatactagctgtggtgatcactctttgtgctatcatcctgggaggcctcacatggatggacttgctacgagccctcatcatgttgggggacactatgtctggtagaatgggaggacagacccacctagccatcatggctgtattcaagatgtcaccaggatatgtgctgggtgtatttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttctttgactttcataagatcaacaatgtcactggtcatggcttggaggaccattatggctgtgttgttcgtagtcacactcattcctttgtgcaggacaagctgtcttcaaaaacagtctcactgggtagaaataacagcactcatcctaggagcccaagctctgccagtgtacctaatgactcttatgaaaggggcctcaaaaagatcttggcctctcaacgagggcataatggctgtgggtctggttagtctcttaggaagcgctcttttgaagaatgatgtccctttagcaggcccaatggtagcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgagacgtcgaggaaaccaatatgataacccttttggtgaagctggcattgataacagtgtcaggtctctaccccttggcaattccagtcacaatgaccctatggtatatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacatatggaaggtgtgttccacacaatgtggcatgttacaagaggatcagtgatctgccatgagactgggagattggagccatcttgggctgacgtcaggaatgacatgatatcatacggtgggggatggaggcttggagacaaatgggacaaagaagaagacgttcaggttctcgctatagaaccagggaaaaatcccaaacatgtccaaacgaaaccaggccttttcaagaccctaactggagaaattggagcagtaacattagatttcaaacccggaacgtctggttctcccatcatcaacaggaaaggaaaagtcatcggactctatggaaatggagtggtcaccaaatcaggtgattacgttagtgctataacgcaagccgaaagaattggagagccagattatgaagtggatgaggacatttttcggaagaaaagattaactataatggacttacaccccggagctggaaagacgaaaagaattcttccatcaatagtgagagaagccctaaaaagaaggctgcgaactttgattctggctcccacgagagtggtggcggccgaaatggaagaggccctacgtggactgccaatccgttaccagaccccagctgtgaaatcagaacacacaggaagagagattgtagacctcatgtgtcatgcaaccttcacaacaagacttttgtcatcaactagggttccaaattacaacctcatagtaatggacgaggcacatttcaccgatccttccagtgtcgcggctagaggatacatttcgaccagggtggaaatgggagaagcggcagccatcttcatgaccgcaaccccccccggagcgacagatccctttccccagagcaacagcccaatagaagacatcgagagagagattccggaaaggtcatggaacacagggtttgattggataacagactatcaagggaaaactgtgtggtttgttcccagcataaaagctggaaatgatattgcaaattgtttgagaaagtcgggaaagaaagtcattcagttgagtaggaaaacctttgacacagaatatccgaaaacgaaactcacggactgggactttgtggtcactacagacatatctgaaatgggggctaactttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccattaaaaaatgatgaagatcatgcccactggacagaagcaaagatgctgcttgacaatatctacaccccagaagggatcattccaacactgtttggtccggaaagggaaaaaacccaagccattgatggagagtttcgtctcagaggggaacaaaggaagacttttgtggaattgatgaggagaggagaccttccagtgtggctgagctataaggtagcatctgctggcatttcttacaaagatcgggaatggtgcttcactggggaaagaaacaatcaaattttagaagaaaacatggaggttgaaatttggactagagagggggaaaagaaaaaactgaggccaagatggttagatgcacgtgtatatgctgaccccatggctttgaaggatttcaaggagtttgccagtggaaggaagagtttgactctcgacattctaacagagattgccagtttgccaacttatctttcctctagggccaagctcgcccttgataacatagtcatgctccacacaacagaaagaggagggagggcctatcaacatgccctgaacgaacttccggagtcactggaaacactcatgcttgtagccttactaggtgctatgacagcaggcatcttcctgtttttcatgcaagggaaaggaatagggaaattgtcaatgggtttgataaccattgcggtggctagtggcttgctctgggtagcagaaatccaacctcagtggatagcggcctcaatcatactggaattttttctcatggtactgttgataccagaaccagaaaaacaaaggaccccacaagacaatcaattgatctacgtcatattgaccattctcaccattataggtctaatagcagccaacgagatggggctgatagaaaaaacaaaaacggattttgggttttaccaggtaaagacagaaaccaccatcctcgatgtggatttgagaccagcttcggcatggacgctctatgcagtagccaccacaattctgactcccatgctgagacacaccatagaaaacacatcggccaacctatctttagcagccattgccaaccaggcagccgtcctaatggggcttggaaaaggatggccgctccacagaatggacctcggtgtgccgctgctggcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagagccaatatcctatgacccaaaatttgaaaagcaattagggcaggtcatgctactagtcctgtgtgctggacaactactcctgatgagaacaacatgggctttctgtgaagtcttgactttggccacaggaccaatcttgaccttgtgggagggcaacccgggaaggttttggaacacgaccatagccgtatccacagccaacattttcaggggaagttacttagcgggagctggactggctttttcactcataaagaatgcacaaacccctaggaggggaactgggaccacaggagagacactgggagagaagtggaagagacagctaaactcattagacagaaaagagtttgaagaatataaaagaagtggaatactggaagtggacaggactgaagctaagtctgccctgaaagatgggtctaaaatcaagcatgcagtgtctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgatacctatggctacttatggctggaatttggtcaaactccattcaggggttgacgtgttctataaacccacagagcaagtggacaccctgctctgtgatattggggagtcatcttctaatccaacaatagaggaaggaagaacattaagagttctgaagatggtggagccatggctctcttcaaaacctgaattctgcataaaagtccttaacccctacatgccaacagtcatagaagagctagagaaactgcagaggaaacatggtgggaaccttgtcagatgcccgctgtccaggaactccacccatgagatgtattgggtgtcaggagcgtcgggaaacattgtgagctctgtgaacacaacatcaaagatgttgttgaacagattcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtaccatggaagctatgaagctccttcgacaggctctgcatcctctatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggtcatgaccacgacagccaattggctatgggccctccttggaaagaagaagaatcccagactgtgcacaaaggaagagttcatctcaaaagttagagcaaacgcagccataggcgcagtctttcaggaagaacagggatggacatcagccagtgaagctgtgaatgacagccggttttgggagctggttgacaaagaaagggcccttcaccaggaagggaaatgtgaatcgtgtgtctacaacatgatgggaaaacgtgagaaaaagttaggagagtttggcagagccaagggaagccgagcaatctggtacatgtggctgggagctcgttttctggaatttgaagccctgggttttttgaatgaagaccactggtttggcagagaaaattcatggagtggagtggaaggggaaggtctgcacagattgggatacatcctggaggagatagacaagaaggatggagacctaatgtatgctgacgatacagcaggctgggacacaagaatcactgaggatgaccttcaaaatgaggaactgatcacggaacagatggctccccaccataagatcctagccaaagctattttcaaactaacctatcaaaacaaagtggtgaaagtcctcagacccacaccgagaggagcggtgatggacatcatatccaggaaagaccaaagaggtagtggacaagttggaacatatggtttgaacacattcaccaacatggaagtccaactcatccgccaaatggaagctgaaggagtcatcacacaagatgacatgcagaacccaaaagggttgaaagaaagggttgagaaatggctgagagagtgtggtgtcgacaggttaaaaaggatggcaatcagtggagacgattgcgtggtgaagcccctagatgagagatttgccacttccctcctcttcttgaacgacatgggaaaggtgaggaaagacataccgcagtgggaaccatctaagggatggaaaaactggcaagaggttcctttttgctcccaccactttcacaagatctttatgaaggatggccgctcactagtagttccatgtagaaaccaggatgaactgatagggagagctagaatctcgcagggggctggatggagcttgaaagaaacagcctgcctggccaaagcttacgcccagatgtggtcgcttatgtacttccacagaagggatctgcgtttggcctccatggccatatgctcagcagttccaacggaatggtttccaacaagcagaacaacatggtcaatccacgctcatcaccaatggatgaccactgaagacatgctcaaagtgtggaacagagtgtggatagaggacaaccccaatatgattgacaagactccagtccattcgtgggaagacataccttacctagggaaaagagaggatttatggtgtggatccttgattggactttcttctagagccacctgggcgaagaacattcacacggccataactcaggtcaggaacctgatcggaaaagaggaatacatggattacatgccagtaatgagaagatacagtgctccttcagagagtgaaggagttctgtaa

SEQ ID NO: 7899 - RNA, 9867 nt, synthetic construct
  misc_feature 1..9867: note = derived and/or modified CDS sequence (wt) from DENV-4__KU523871__SS-prME
  source 1..9867: mol_type = other RNA
tcgacaatgacattgctgtgtttgattcccaccgtgatggcgtttcacctgtcaacaagagatggcgaacccctcatgatagtggcaaaacacgaaagggggagacctctcttgtttaagacaacagaagggatcaacaaatgtacccttattgctatggacctgggtgaaatgtgcgaagacactgtcacgtataagtgtcctctactggttaacaccgaacctgaagacattgactgctggtgcaatctcacgtccacctgggtcatgtacgggacatgcacccagaacggagaacggagacgagagaagcgctcagtagctttaacaccacattcaggaatgggattggaaacaagagctgagacatggatgtcatcggaaggggcttggaaacatgctcagagagtagaaagctggatactcagaaacccaggattcgcgctcttggcaggatttatggcttatatgattgggcaaacaggaatccagcgaattgttttctttgtcctgatgatgctagtcgccccatcctacggaatgcgatgcgtaggggtagggaacagagacttcgtggaaggagtctcgggtggagcatgggtcgacttggtgctagaacatggaggatgcgtcacaaccatggcccagggaaagccaaccttagattttgaattgactaagacaacagccaaggaagtagctctgttaagaacctattgcattgaagcctcgatatcaaacataaccacggcaacaagatgtccaacgcaaggagagccttatctcaaagaggagcaagaccaacagtacatttgccggagagacgtggtagacagaggatggggcaatggctgtggcttatttggaaagggaggagttgtgacatgtgcaaagttttcatgttcggggaagataacaggcaatctggtccaaattgaaaaccttgaatacacagtagtagtaacagtccacaatggagacacccatgcagtaggaaatgacacatccaaccatggagtgacagccacaataactcctaggtcaccatcggtagaagttaaattgccggactatggagaactaacactcgattgcgagcccaggtccggaattgattttaatgagatgatcctgatgaagatgaaaaagaaaacgtggcttgtgcataagcaatggtttttagacctacctctaccatggacggcaggagcagatacatcagaagttcattggaatcataaagagagaatggtgacattcaaggttcctcatgccaagagacaggatgtgacagtgctaggatctcaggagggggctatgcattctgccctcgccggagccacagaagtggattctggtgatggaaatcacatgtttgcaggacatctcaagtgcaaagtccgcatggagaaattgagaattaaaggaatgtcatacacgatgtgttcaggaaagttctcaattgacaaagagatggcagaaacacagcatggaactacagtggtgaaagtcaagtatgaaggcgctggagctccgtgtaaagttcccatagagataagagatgtgaacaaggaaaaagtggtcggacgtatcatctcatctaccccttttgctgagaataccaacagcgtaaccaacatagaattagaacccccttttggggacagctacatagtgataggtgttggagagagtgcattaacactccattggttcagaaaagggagctccattggcaagatgtttgagtccacatacagaggtgcaaaacgaatggccattctaggtgaaacagcttgggattttggctctgttggtggactgttcacatcattgggaaaggccgtacaccaggtttttggaagtgtgtatacaactatgtttggaggggtctcatggatggttagaatcctaattggattcttagtattgtggattggcacaaattcaagaaacacttcaatggcaatgacgtgcatagctgttggaggaatcactctgtttctgggttttacagttcaagcagacatgggttgtgtggtgtcatggagtgggaaggaattaaaatgtggaagcggaatttttgtggttgacaacgtgcacacttggacagaacagtacaaatttcaaccagagtccccagcaagactagcgtctgcaatattgaatgcccacaaagatggggtctgtggaattagatcaaccacgaggctggaaaatgttatgtggaagcaaataaccaatgagctaaactatgttctctgggaaggaggacatgacctcactgtagtggctggggatgtgaagggggtgttgaccagaggcaagagagcactcacacctccagtgaatgatctgaaatattcatggaagacatggggaaaagcaaaaatctttaccccagaagcaagaaacagtacgtttttaatagacggaccagacacctccgaatgccccaatgagcgaagagcatggaacttttttgaggtagaagactatggatttggcatgtttacgaccaacatatggatgaaattccgagaaggaagttcagaagtgtgtgaccatagactaatgtcggcggcaatcaaagatcagaaagctgtgcatgctgacatgggttattggatagagagctcaaaaaaccagacctggcagatagagaaagcatcccttattgaagtgaaaacatgtctgtggcccaaaacccacacgctgtggagcaatggagtgctggaaagtcagatgctcattccaagatcatatgcaggccccttttcacagcacaattaccgtcagggctatgccacgcaaaccgtgggcccatggcacctaggcaaattggagatagactttggagaatgccccgggacaacagtcgcaattcgggaggattgtgaccacagaggcccatctttgagaaccaccactgcatctggaaaactggtcacgcaatggtgctgccgctcctgcacgatgcctcccttaaggttcttgggagaagatggatgttggtatgggatggagatcaggcctctgagtgaaaaagaagagaacatggtcaaatcacaggcaacggccggacagggcacatcagaaactttttctatggggctgttatgcctgaccttgtttgtggaagaatgcttgaggagaagagttactaggaaacacatgatattggttgtggtaatcaccttttgcgctatcatcctaggaggtctcacatggatggacttactacgagcccttatcatgttaggggatactatgtctggtagaataggaggacagatccacctagccatcatggcagtgtttaagatgtcaccaggatacgtgctgggtgtgtttttaaggaaacttacttcaagagagacagcgctgatggtaataggaatggccatgacaacggtgttttcaatcccacatgaccttatggaactcattgatggaatatcattggggttgatattactaaaaatagtaacacattttgacaacacccaagtgggaaccctagccctttccttgacttttttaagatcaacaacaccattagtcatggcttggaggaccattatggctgtgttctttgtggtcacactcattcctttgtgtaggacaagctgtcttcaaaaacagtcccactgggtagaaataacagcactcatcctaggagcccaggctttgccagtatacctaatgactctcatgaagggagcctcaaggagatcttggcctctcaatgagggcataatggctgtaggtttggtgagcctcttaggaagcgccctcttgaagaatgatgttcctttggctggcccaatggtggcaggaggcttgcttctagcggcttacgtaatgagtggtagctcagcagacctgtcactagagaaagctgccaacgtgcagtgggatgaaatggcggacataactggctcaagcccaatcatagaagtgaagcaggatgaagatggctctttttccatacgggacgtcgaggaaaccaatatgatgactctcttggtgaaactggcactgataacagtatcaggtctttaccccttggcaattccagtcacaatggcattatggtatatttggcaagtgaagacacaaagatcaggagctctgtgggacgtcccctcacccgctgccacccagaaagccacactgtctgaaggagtgtataggattatgcaaagagggctgtttgggaaaactcaagttggagtaggaatacacatggaaggcgtatttcacacaatgtggcatgtaacaaggggatcagtgatctgtcatgagacagggagattagagccatcttgggctgacgtcagaaacgacatgatatcatacggtgggggatggaggctcggagacaaatgggacaaagaagaagatgttcaggtcttagccatagaaccagggaaaaatcccaaacatgtccaaacgaaacctggccttttcaagaccctaactggagaaattggagcagtaactctggatttcaaacccggaacgtctggctctcccatcattaacaagaaagggaaagttattggactctatggaaatggagtggttaccaaatcaggtgattatgtcagtgccataacgcaagccgagagaattggtgagccagattatgaagttgatgaggacatttttcgaaagaaaagattaaccataatggatttacaccccggagctggaaagacaaaaagaatcctcccatcaatagtcagagaggctttaaaaaggaggctgcgaaccctgattttggctcccacgagagtggtggcggccgagatggaagaggccctacgtgggttgccaatccgttatcagactccagctgtgaaatcagagcacacaggaagagagattgtagacctcatgtgtcatgcaacctttacaacaagacttttgtcatcaaccagggttcctaattataacctcatagtgatggatgaagcacatttcactgacccttgcagtgtcgcggctagaggatacatttcaaccagggtggaaatgggagaggcagcagctatcttcatgactgcaacccctcctggagcgacagatcctttcccccagagcaacagcccaatagaagacatcgagagggaaattccagaaaggtcatggaacacagggttcgactggataacagactaccaagggaaaactgtgtggtttgttcccagcataaaagctggaaatgacattgcaaattgtttgagaaagtcgggaaagagagtgatccagttgagcaggaaaacctttgacacggagtatccaaagacgaaactcacggactgggattttgtggtcaccacagatatatctgaaatgggggccaatttcagagctgggagagtgatagaccccaggagatgcctcaagccagttatcctaacagatgggccagagagagttattctagcaggtccaatcccagtaactccagcaagtgccgctcagagaagagggcgaataggtaggaatccagcacaggaagatgaccaatatgttttctccggagacccactaaaaaatgatgaagatcatgctcactggacagaagcaaagatgctgcttgacaatatctacacccctgaagggataattccaacactgtttggtccggaaagggaaaaaacccaagccatcgatggagagtttcgcctcagaggggaacaaaggaagacttttgtggaattaatgaagagaggagaccttccggtgtggctgagctacaaggtagcttctgccggtatctcctacaaagatcgagaatggtgcttcacaggagaaaggaataaccaaattttagaagaaaacatggaggttgaaatttggactaaagagggagaaaagaaaaagctaaggccaaaatggttggatgcacgtgtgtacgctgatcccatggctttgaaggatttcaaggagttcgccagtggaagaaagagcataactctcgacatcttaacagagattgccagtttgccaacttacctttcctctaaggccaagctggctcttgacaacataatcatgctccacacaacagaaaaaggagggagggcctaccaacacgccctgaacgaactcccggagtcactggaaacgctcatgcttgtagctctactaggtgctatgacagcaggcatcttcctgtttttcatgcaggggaaaggaataggaaaattgtcaatgggtctaatagccatagctgtggctagtggcttgctctgggtagcagaaattcagccccagtggatagcagcttcaatcatactggagttctttcttatggtgctgttgataccagaaccagaaaaacaaaggaccccacaagacaatcaattgatctacgtcatattgaccattctcaccatcatcggtcttatagcagccaatgagatggggctgattgaaaaaacaaaaactgactttgggttttaccaggtaaaaacagaaacaactattcttgatgtggatttgagaccagcctcagcatggacactctatgcggtagccaccaccattctgactcccatgctgagacacaccatagaaaacacgtctgccaacctatctctagcagccattgccaaccaagcagctgttctaatgggacttggaaaaggatggccgctccacagaatggacctcggtgtgccgctgttagcaataggatgttattctcaagtgaacccaacaaccctgacagcatccttagtcatgcttttagtccattatgccataataggtccaggattgcaggcaaaagccacacgagaggcccagaaaaggacagctgctgggatcatgaagaaccccacggtggacgggataacagtaatagatctagaaccaatatcctatgacccaaaatttgaaaagcaattagggcaagtcatgttactagtcctgtgtgctggacaattacttttgatgagaacaacatgggctctctgcgaagtcttgactttggccacaggaccagccatgaccttgtgggagggcaacccgggaaggttttggaacacgaccatagctgtatccacagccaacattttcagaggaagctatctggcaggagctggactagctttttcgctcataaagaatgcacaaacccctaggaggggaactgggaccacaggagagacactgggagagaagtggaagagacagttaaactcattagacagaaaagagtttgaagagtacaaaagaagtggaatactagaagtggataggactgaagccaagtctgccctaaaagatggatctaaaatcaagcatgcggtgtccagagggtctagtaagatcagatggattgttgaaagagggatggtaaagccgaaagggaaggtcgtggatcttggttgcgggaggggaggatggtcctattacatggcgacacttaagaacgtgactgaagtgaaaggatatacaaaaggaggtccaggacatgaggaaccaatccccatggctacttatggctggaacttggtcaaactccattcaggggttgatgtgttttacaaacccactgagcaggtggacaccttgctctgtgacattggggagtcgtcctctaatccgacaatagaggaaggaaggacattgagagtcttgaagatggtagagccatggctctcttcaaaacctgagttctgcatcaaagtcctcaacccctacatgccgacagttatagaagagctggagaaactgcagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcatagaaaacccacttatgagaaggacgtagatcttggggcaggaacgagaagtgtctccactgaaacagaaaaaccagacatgacaatcattgggagaaggcttcagagattgcgagaagagcacaaagaaacctggcactatgaccaggaaaacccatatagaacctgggcgtatcatggaagctatgaagctccttcgacaggttcagcatcctccatggtgaacggggtagtaaaactgctgacaaaaccttgggatgtggttccaatggtgactcagttggccatgacagacacaaccccttttgggcaacaaagagtgtttaaggagaaggtggataccagaacaccacaaccaaaacccggcacacgaatgattatgaccacgacagccaattggttgtggaccctcctcgggaagaagaaaagtcccagactgtgcacaagggaagagttcatctcaaaagttaggtcaaatgcagccataggcgcagtctttcaggaagaacagggatggacatcagccagtgaagctgtgaatgacagccggttctgggaactggttgacaaagaaagggctctgcaccaggaaggaaaatgtgaatcgtgtgtttacaacatgatgggaaaacgtgagaaaaaattaggagagtttggtagggccaagggaagccgagcgatgtggtacatgtggctgggggcgcggttcctggaatttgaagccctgggttttttgaatgaagatcattggtttagcagagaaaactcatggagtggagtggaaggggaaggtctgcacagattgggatacatcttggaggacatagacaagaaggatggagacctgatatatgctgacgacacagcaggctgggacacgagaatcactgaggatgacctcttaaatgaagaactgatcacagaacagatggccccccatcacaagaccctagccaaagccattttcaaactaacctatcaaaacaaagtggtgaaagtcctcagacccacaccgaaaggagcggtgatggacatcatatccaggaaagaccaaagaggtagtggacaggttggaacatatggtttaaacacattcactaacatggaagttcaactcatccgccaaatggaagctgaaggagtcatcacacaagacgacatgcagaacccaaaagggttgaaagaaagagttgagaaatggctgacagagtgtggcgtcgacaggttgaagaggatggcaatcagtggagatgattgcgtggtgaagcccctagatgagaggttcagcacctccctcctcttcttgaacgatatgggaaaggtgaggaaagacatcccgcagtgggaaccatccaaaggatggaaaaactggcaagaggttcctttttgctcccaccattttcataagatctttatgaaagatggccgctcactagttgttccatgcagaaaccaggatgaactgataggaagagccagaatctcgcaaggggctggatggagcttgagagaaacagcctgtttgggcaaagcttacgcccaaatgtggtcgcttatgtatttccatagaagggacctacgtttagcctccatggccatatgttcagcagttccaacggaatggtttccaacaagcaggacaacatggtcaatccacgctcatcaccagtggatgaccactgaagacatgctcaaagtgtggaacagggtgtggatagaagacaaccccaatatgactgacaagactccagtctattcgtgggaagacataccttacctagggaaaagagaggatttgtggtgtggatccctgattggactctcttccagagccacctgggcgaagaacattcacacggccataacccaggtcaggaatctgatcggaaaagaggactacgtggattacatgccaatcatgaaaagatatagcgctccttccgaaagtgaaggagttctgtaa

SEQ ID NO: 7900 - RNA, 9867 nt, synthetic construct
  misc_feature 1..9867: note = derived and/or modified CDS sequence (wt) from DENV-4__HQ332175__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaagccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgtcggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggagttacagccacgataactcccaggtcaccatcggtagaagtcaaactgccggactatggagaactaacactcgactgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtagtgaaagtcaagtatgaaggtgctggagctccgtgtaaagtccccatagagataagagatgtaaacaaggaaaaagtggttgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagtggaatctttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaaaacatgggggaaagcaaaaatcttcacccctgaagcaagaaacagcacatttttaatagacggaccagatacctctgaatgccccaatgaacgaagagcatggaattcttttgaggtggaagactatggatttggtatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgtttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgtttaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagtagatctgtcactagagaaggccgctaatgtgcaatgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtccgaaggagtgtacaggatcatgcaaagagggttattcgggaaaactcaggttggagtagggatacacatggaaggtgtatttcatacaatgtggcatgtcacaagaggatcggtgatttgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctatcccagtgactccagcaagcgctgcccagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagatcttccggtgtggctgagttataaggtagcttctgctggcatttcttacaaagatcgggaatggtgtttcactggggaaagaaataaccaaattttagaagaaaacatggaggttgaaatttggactagagagggagaaaagaaaaaactgagaccaaaatggttagatgcacgtgtatacgctgaccccatggctttgaaggatttcaaggagtttgccagtggaaggaagagtataactctcgacatcctaacagagatcgccagtttgccaacctacctttcctctagggccaagctcgcccttgacaacatagttatgcttcacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaacacgtcggccaacctatctttagcagctatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattccaatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcacaggaaacccacttatgagaaggacgtagatcttggggcaggaacgagaagtgtctccactgaaacagaaaaaccagacatgacaatcattgggagaagacttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctaggagcgcggtttctggaatttgaagccctgggttttttgaatgaagaccattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccatcttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccaccgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccatagctcaggtcaggaatctgatcggaaaagaggaatacgtggattacatgccagtaatgaaaagatacagtgctccttcagagagtgaaggagttctgtaa

SEQ ID NO: 7901 - RNA, 9867 nt, synthetic construct
  misc_feature 1..9867: note = derived and/or modified CDS sequence (wt) from DENV-4__HQ332172__SS-prME
  source 1..9867: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctgcctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagacggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccatacactgtggagcaatggagtgctggaaagccagatgcttattccaaaatcatatgcgggccctttttcacagcacaattaccgccagggctatgctacgcaaactgtgggtccatggcacttaggcaaactagagatagactttggagaatgccccggaacaacagtcacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcctaggaagcgctcttttaaaaaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccactgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgatatgatatcatacggtgggggatggaggcttggagataaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaaggattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagctaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccatcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgccttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacatttttaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaaaaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccttacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgatcttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaacgacatgggaaaggtgaggaaagatattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtctagcctccatggccatatgctcagcagttccaacggaatggtttccaacaagcagaacaacatggtcaatccatgctcaccaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7902 - RNA, 9867 nt, synthetic construct
  misc_feature 1..9867: note = derived and/or modified CDS sequence (wt) from DENV-4__HQ332176__SS-prME
  source 1..9867: mol_type = other RNA
tcaacgataacattgttgtgcttgattcccaccgtaatggcgtttcacttgtcaacaagagatggcgaacccctcatgatagtggcaagacatgaaagggggagacctctcttgtttaagacaacagaggggatcaacaaatgcactctcattgccatggacttgggtgaaatgtgtgaggacactgtcacgtataaatgtcccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccgtagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggagttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcttaattgggttcttagtgttgtggattggcacgaactcaaggaacacttcaatggccatgacgtgcatagctgttggtggaatcactctgtttttgggcttcacggtccaagcggacatgggttgtgtggtgtcatggagtgggagagaattgaagtgtggaagcggaatttttgtggttgacaacgtgcatacttggacagaacagtacaaattccaaccagagtccccagcgagactagcgtctgcaatattaaatgcccacaaagatggggtctgtggaattagatcaaccacgagactggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctctcattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgagaagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtccgaaggagtgtacaggatcatgcaaagagggttattcgggaaaacccaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagataaatgggacaaagaagaggacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactataaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcccattccagtgactccagcaagcgctgcccagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgacaacatagttatgctccacacaacagaaagaggagggagggcctatcaacacgccttgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggctacaggaccaatcttgaccttgtgggagggcaacccgggaaggttttggaacacgaccatagccgtatctaccgccaacattttcaggggaagttacttggcaggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtccgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcctatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaggtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaaccctcttatgagaaggacgtagatcttggggcaggaacgagaagtgtctccactgaaacagagaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtaaacggggtggtgaaactgctaacaaaaccctgggatgtaattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtctagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 7903 - RNA, 9867 nt, synthetic construct
  misc_feature 1..9867: note = derived and/or modified CDS sequence (wt) from DENV-4__HQ332174__SS-prME
  source 1..9867: mol_type = other RNA
tcaacgataacattgttgtgcttgattcccaccgcaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgttcagtagctttaacaccacattcaggaatgggactggaaacaagagctgagacatggatgtcatcggaaggggcttggaagcatgctcagagagtagagagctggatactcagaaatccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacgagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagacacatcagaggttcactggaattacaaagagagaatggtgacatttaaggttcctcatgccaagagacaggatgtgacagtgctgggatctcaggaaggagctatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgtcatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaagttccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccatacactgtggagcaatggagtgctggaaagccagatgcttattccaaaatcatatgcgggccctttttcacagcacaattaccgccagggctatgctacgcaaaccatgggtccatggcacttaggcaaactagagatagactttggagaatgccccggaacaacagtcacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcgcatcggaaactttttctatgggtctgttgtgcctgaccttgtttgtggaagaatgcttgaggagaagagtcaccaggaaacacatgatattagctgtggtaatcactctttgtgctatcatcctagggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggccccttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgatgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaaccggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggccctattccagtgactccagcaagcgctgctcagagaagagggcgaataggaaggaacccagcacaagaagacgaccaatacgttttctccggagacccactaaaaaatgatgaagatcatgcccactggacagaagcgaagatgctgcttgacaatatctacaccccagaagggatcattccaacattgtttggtccggaaagggaaaaaacccaagctattgatggagagtttcgccttagaggggaacaaaggaagacttttgtggaattaatgaggagaggagaccttccggtgtggctgagttataaggtagcttctgctggcatttcttacaaagatcgggaatggtgcttcactggggaaagaaacaaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaacctcagtggatagcggcctcaatcatactagagttttttctcatggtactgttgataccagaaccagagaaacaaaggaccccacaagacaatcaattgatctacgtcatattgaccattctcaccattattggtctaatagcagccaacgagatggggctgatagaaaaaacaaaaacggattttgggttttaccaggcaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaattattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagatacaaccccttttgggcaacaaagagtgttcaaagagaaggtggataccagaacaccgcaaccaaaaccaggcacacgaacagttatgactacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactagttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgatcttcaaaatgaggaactgatcacggaacagatggccccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgactgcgtggtgaaacccctagatgagaggtttggcacttccctcctcttcttgaacgacatgggaaaagtgaggaaagatattccgcagtgggaaccatctaagggatggaaaaactggcaagaggttcctttttgctcccaccactttcacaagatctttatgaaggatggccgctcactagtagttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatatagtgctccttcagagagtgaaggagttctgtaa

SEQ ID NO: 7904 - RNA, 9867 nt, synthetic construct
  misc_feature 1..9867: note = derived and/or modified CDS sequence (wt) from DENV-4__KT026308__SS-prME
  source 1..9867: mol_type = other RNA
tcaacaataacattgctgtgcttgattcccactgtaatggcgtttcacttgtcaacgagagatggtgaacccctcatgatagtggcgaaacacgaaagggggagacctctcttgtttaagacaacagaaggaatcaataagtgcactcttattgccatggacctgggtgagatgtgtgaggacaccgtcacgtataaatgccccttactggtcaataccgaacccgaagacattgattgctggtgcaatctcacgtctacctgggttatgtatgggacatgcacccaaagtggagaacgaaggcgagagaagcgctcagtagctctaacaccacattcaggaatgggattggaaacaagggctgaaacatggatgtcatcggaaggagcttggaaacacgcccagagggtagagagttggatactcagaaacccaggattcgcgctcttggcagggtttatggcctacatgatcgggcaaacaggaatccagcgaacagtcttcttcattctaatgatgttggtcgccccatcttacggaatgcgatgcgtaggagtagggaacagagactttgtagaaggagtctcaggtggagcatgggtcgatctggtgctagaacatggaggatgtgtcacaaccatggcccagggaaagccaaccttggattttgaactgattaagacaacagccaaggaagtggctctgttaagaacctattgcattgaagcttccatatcaaacataaccacagcaacaagatgtccaacgcaaggagagccttacctcaaagaggaacaagatcaacagtacatttgccggagagacatggtagatagagggtggggcaacggttgtggcttgtttgggaagggaggagttgtgacatgtgcgaagttttcatgcttggggaagataacgggcaacttagttcaaattgagaaccttgaatacacagtggttgtaacagtccacaatggagacactcacgctgtaggaaatgacacatctaaccatggagtgacagccacaataacccccaggtcaccatcggttgaagttcaattaccggactatggagaattgacactcgactgtgaacctaggtccggaattgactttaatgagatgattctgatgaaaatgaaaacgaaaacgtggctcgtgcacaagcaatggtttttggatctacctctaccatggacaacaggagcagacacgctagaagttcactggaatcacaaagagagaatggtgacattcaaggttcctcatgccaagagacaggacgtgacagtgctaggatctcaggaaggagccatgcattcagccctcgccggagccacagaagtggactccggtgatggaaaccatatgtttgcaggacacttaaagtgtaaagttcgtatggaaaagttgaggattaagggaatgtcatacacgatgtgctcaggaaagttctcaattgataaagagatggcagaaacacagcatggaacaacagtggtaaaggtcaagtatgagggtactggagctccatgtaaagttcccatagagataagagatgtgaacaaggaaaaagtggttgggcgcatcatctcatccaccccttttgctgagaataccaacagtgtgaccaatatagaattggaacctccttttggggatagctacatagtgataggtgtgggagacagtgcattaacactccattggttcaggaaagggagctccattggcaagatgtttgagtccacatacagaggtgcaaagcgcatggccattctaggtgaaacagcttgggattttggttccgttggtggactgctcacgtcattaggaaaggctgtacatcaagtttttggcagtgtgtacacaactatgtttggaggagtctcatggatggtcagaatcctaatcggactcttagtgttgtggattggtacgaattcaagaaacacttcaatggctatgtcgtgcatagctgttggaggaatcaccctgtttctgggcttcacagtccatgcagatatgggttgtgtggtgtcatggagtgggaaagagttgaaatgtggaagcggaatctttgtaattgacaacgtgcacacctggacagaacagtacaaatttcaaccagagtctccagcgcgactggcgtcggcaatactgaatgcccacaaagaaggggtctgtggaattagatcaaccacgaggctggaaaatgtcatgtggaaacaaataactaatgagttaaactatgttctctgggaaggaggacatgacctcactgtagtggccggggatgtgaaaggggtgctgtccaaaggcaagagagcactcgcacctccagtgaatgacctgaaatattcatggaagacatgggggaaagcaaagatctttactccagaaacaagaaacagcacgtttttggtggacggaccagacacctccgaatgccccaatgaacgaagagcatggaactttcttgaggtggaagactatggatttggcatgttcacgaccaacatatggatgaaatttcgagaaggaagttcagaagtgtgtgaccataggctgatgtcggcagcaatcaaagaccagaaagctgtgcatgctgacatgggctattggatagagagctcaaaaaaccagacctggcagatagagaaggcatccctcatagaagtgaaaacatgtctgtggcccaagacccacacattgtggagcaatggagtgctggaaagtcagatgctcatcccaaaagcatatgcaggccctatttcacagcacaactatcgccagggctatgccacgcagaccgcaggcccatggcacttgggcaaattggaaatagactttggagaatgccccggaacaacagtcactgtacaagaggattgtgaccatagaggcccatctttgagaaccaccactgcatctggaaaattggtcacgcagtggtgctgtcgctcctgcacgatgccccccttaagatttttaggagaggatggatgctggtatggaatggaaatcaggcccttgaatgaaaaagaagagaacatggtcaaatcacaggtttcagccggacatggtacatcagagactttttctatggggctgttgtgcctgactttgtttgtggaagaatgcttgaggagaagagtcaccaggaaacacatgatattggttgtggtgaccaccctttgtgccatcattttaggaggtcttacatggatggacttactgcgtgcccttatcatgctaggggacaccatgtctggtagaatggggggacagattcatctagccatcatggcagtgttcaagatgtcaccaggatacgtgttgggtatatttctgaggaaactcacctcaagagagacagcactgatggtaataggaatggccatgacaacggtgctttcaattccacatgaccttatggaattcattgatggaatatcattagggttaatcttattaaaaatggtaacacattttgacaacactcaagtgggaaccttagcccttgccttgacctttataaaatcaacaatgccattggtcatggcttggaggaccataatggctgtgttgtttgtggtcacactcattcctctatgtaggacaagctgtcttcaaaagcagtcccattgggtggaaataacagcactcatcctgggagcccaggctctgccagtatacctaatgactctcatgaaaggagcctcaaaaagatcttggccccttaacgagggtataatggctgtgggcttggtcagtctcttaggaagcgcccttctaaagaatgatgtccctttagctggcccaatggtggcaggaggcttacttctggcagcctacgtgatgagcggcagctcagcagacctgtcactggagaaggctgccaatgtgcagtgggatgagatggcagacataacaggctcaagcccaatcatagaagtgaagcaggatgaagatggctctttctccatacgggacgtcgaggaaaccaacatgattaccctcctggtgaaactggcactgataacagtgtcaggtctctaccccttggcaattccagtcacaatgaccctatggtacatgtggcaagtgaaaacacaaagatcaggagccctgtgggacgtcccctcacctgctgccgctcagaaagctacactgactgagggagtatacaggatcatgcaaagagggttgtttggaaaaacccaggttggagtagggatacacacggaaggtgtgtttcatacaatgtggcatgtaacaagaggatcagtgatttgtcatgagagtgggagactggagccatcttgggctgacgtcaggaacgacatgatatcatacggtgggggatggaggctcggagataaatgggataaagaagaagatgttcaagttctagctatagaaccagggaaaaatccgaaacatgtccaaacgaaacccggcctcttcaaaacccttactggagaaattggagcagtaacattggacttcaaacccggaacatccggttctcccatcattaacaggaaaggaaaagtcattggactctacggaaatggggtagttaccaaatcaggtgattacgttagtgccataacacaagctgaaagaattggtgagccagactatgaagtggatgaggacattttccgaaagaaaagattaactataatggatttacatcccggagccggaaagacaaaaagaatcctcccatcaatagttagagaagccttaaaaaggaggctgcgaaccttgattctggctcccacgagagtggtggcggccgaaatggaagaagcgctacgtggactgccaatccgttatcagaccccagctgtgaaatcagaacacacaggaagagagatcgtagacctcatgtgtcatgcaacctttacaacaagacttttatcatcaaccagggttccaaattacaacctcatagtgatggatgaagcgcatttcacagacccttctagtgttgcagctagaggatatatctcaaccagagtggaaatgggagaggctgcagctgtttttatgactgcaacccctcctggaacgacagatcccttcccccagagcaacagcccaatagaagacatcgagagagaaatcccagaaaggtcatggaacacagggtttgactggataacggactaccaagggaaaactgtgtggtttgttcccagcataaaagctggaaatgacattgcaaattgcttgagaaaatcgggaaagaaggtcatccaattgagcaggaaaaccttcgatacagagtatccaaaaacgaaactcacggactgggattttgtgattaccacagacatatctgaaatgggggccaattttagagctgggagagtgatagaccccaggagatgtctcaagccagttatcttaactgatgggccagagagagttattttagctggtcccattccagtgactccagcaagcgccgctcagagaagagggcgaataggtaggaacccagcacaagaagatgaccagtatgtcttctccggagacccactaaggaatgatgaagatcatgcccactggactgaagcaaagatgcttcttgataatatctacaccccagaagggatcattccaacactgtttggtccagaaagggaaaaaacccaagccattgacggagagttccgcctcagaggggaacaaaggaagacctttgtagaactaatgaggagaggagaccttccggtgtggctgagccacaaggtagcttctgctggtatctcttacaaagaccgggaatggtgcttcacgggggaaaggaataaccaaattttggaagaaaacatggaggttgaaatttggactagggagggagagaagaaaaaactcaggccaaaatggttagatgcacgtgtttacgctgatcccatggctttgaaggatttcaaggagtttgccagtggaagaaagagcataaccctcgacatcttgacagaaatcgccagtctgccaacgtacctttcctccagggctaagctcgcccttgacaacatagtcatgctccatacaacagaaagaggagggaaggcctaccaacacgctctgaacgaactcccagagtcactagaaacactcatgcttgtagctttattaggagccatgacagcaggcatcttcctattcttcatgcaaggaaaaggaatgggaaaattgtcaatgggtctgatagccattgcggtagctagtggcttgctctgggtggcagaaatccagccccaatggatagcggcctcaatcatattggagttttttctcatggtgttgttggtaccagaaccagaaaaacaaaggaccccacaagacaatcaattgatctacgtcatattgaccattctcactattattgctctcgtggcagccaatgagatggggctaattgaaaaaacaaaaacggattttgggttttaccaggtgaaagcagaaaccaccatccttgatgtggacttgagaccagcttcagcatggacgctctatgcagtagctaccactatcttgacccccatgctgaggcacaccatagaaaacacgtctgcaaacttatccttggcggccattgccaaccaagcagccgtcctgatggggcttggaaaaggatggccgctccacagaatggacctcggtgtgccgctattggcaatgggatgctattcccaagtgaacccaacaactttaacagcatccttggtcatgcttctggtccattatgcaataataggtccaggattgcaggccaaagccacaagagaggctcaaaaaaggacagctgctgggatcatgaagaaccccacggtggacgggataacagttatagatctagaaccaatatcctatgacccaaaatttgagaagcagctggggcaagtcatgctactagttttgtgcgttggacagctactcttgatgagaacaacatgggccttttgtgaagtcttgactttggccacaggaccaatcttgaccttgtgggaaggcaacccgggaaggttttggaacacgacaatagccgtgtccactgccaacattttcaggggaagctacttggcgggagctggattggccttttcgctcataaagaatgcacaaacccccaggaggggaactgggaccatgggagagacactgggagaaaaatggaagagacagctaaactcgctagataggaaggagtttgaagagtacaaaagaagtggaatactagaagtggacaggactgaagccaggtctgccctaaaagatgggtccaaaatcaagtacgcagtgtccagaggtaccagcaagattagatggattgttgaaagagggatggtaaagccaaaagggaaagttgtggatcttggttgcggaaggggaggatggtcgtactatatggcgacactcaagaacgtgaccgaggtgaaagggtatacaaaaggaggtccaggacatgaggaaccgattcccatggctacctatggttggaacttggtcaaactccattcaggggttgacgtgttctacaaacccactgagcaagtggacactctgctctgtgatattggggagtcatcctctaatccgacgatagaggaaggaagaacattacgagttttaaagatggtggagccatggctctcttcaaaacctgaattctgcatcaaagtcctcaatccctacatgccaacagtcatagaggagctggagaaactgcagagacgacatggtggaagtcttgtcagatgcccgctatccaggaattccactcatgagatgtattgggtgtcaggtgtgtcaggaaacatcgtgagttctgtgaacacaacatcaaagatgttgttgaacagatttaccacaaggcacaggaaacccacttatgagaaggacgcagaccttggagcaggaacgagaagtgtctccaccgaaacagaaaaaccagacatgacaatcatcgggagaagactccagcgattgcaagaagagcacaaagaaacttggcactatgatcatgaaaatccatacagaacctgggcgtatcatggaagctatgaagctccttcgacaggctcagcatcctccatggtgaacggggtagttaaactgttgacaaaaccctgggacgtggtaccaatggtgactcagttggctatgacagatacaaccccctttgggcaacagagagtgttcaaggagaaggttgacaccagaacaccacagccaaaaccaggtacacaagtagtcatgaccacgacagccaactggctgtggactctccttgggaggaagaaaaatcccagactgtgcacaagggaagaattcatctcaaaagttaggtcaaatgcagccataggcgcagtctttcaggaagaacagggatggacatcagccagtgaagcagtgaatgacagccggttttgggaactggttgacaaagaaagggctctgcaccaggaagggaaatgtgaatcatgcgtctataacatgatgggaaaacgtgaaaaaaaattgggagaatttggcagagccaagggaagccgagcaatctggtacatgtggctgggagcgcggtttctggaatttgaagccctgggctttttgaatgaagatcactggtttggcagggaaaactcatggagtggagtggaaggggaaggtctgcataggttgggatacatcttggaggacatagacaagaaggatggagatttgatatatgctgatgacacagcaggctgggacacaagaatcactgaagatgaccttctgaatgaagagctgatcacggaacagatgacccctcatcataaaatcctagctaaagccattttcaaactaacttatcaaaacaaagtggtaaaagtcctcagacccacaccgaaaggagcagtgatggacattatatccagaaaagatcaaagaggtagtggacaggttggaacatatggtttgaacacattcaccaacatggaagtacaactcatccgccaaatggaagctgaaggagtcattacacgagatgacatgcataacccaaaagggttgaaagaaagagttgagaaatggctgaaagagtgtggtgtcgacaggttaaagaggatggcaattagtggagacgattgtgtggtgaagcctctagatgagaggttcagcacttccctcctctttttgaacgacatgggaaaggtgaggaaagacattccgcaatgggaaccatccaagggatggaaaaactggcaagaggttcctttttgctcccaccattttcacaagatctttatgaaggatggccgttcactggtcgttccatgtagaaaccaggatgaactaatagggagagcaagaatctcgcaaggggctggatggagtttaagagaaacggcctgtctgggcaaggcttacgcccagatgtggtcgctcatgtactttcatagaagggacctacgtttagcctccatggctatatgctcagcagtcccaacggaatggtttccaacaagtagaacaacatggtcaatccacgctcatcatcagtggatgactactgaagatatgctaaaagtgtggaacagagtatggatagaagacaaccctaacatgattgacaaaactccagttcactcgtgggaagacataccttacctagggaaaagagaggatttgtggtgtggatccttgattggactctcttctagggccacctgggctaagaacattcacacagccataacccaggtcaggaacctaattgggaaagaggaatatgtggattacatgccagccatgagaagatacagcgctcatttcgagagtgaaggagttctgtaa

SEQ ID NO: 7905 - RNA, 9867 nt, synthetic construct
  misc_feature 1..9867: note = derived and/or modified CDS sequence (wt) from DENV-4__KT026309__SS-prME
  source 1..9867: mol_type = other RNA
tcaacaataacattgctgtgcttgattcccactgtaatggcgtttcacttgtcaacgagagatggtgaacccctcatgatagtggcgaaacacgaaagggggagacctctcttgtttaagacaacagaaggaatcaataagtgcactcttattgccatggacctgggtgagatgtgtgaggacaccgtcacgtataaatgccccttactggtcaataccgaacccgaagacattgattgctggtgcaatctcacgtctacctgggttatgtatgggacatgcacccaaagtggagaacgaaggcgagagaagcgctcagtagctctaacaccacattcaggaatgggattggaaacaagggctgaaacatggatgtcatcggaaggagcttggaaacacgcccagagggtagagagttggatactcagaaacccaggattcgcgctcttggcagggtttatggcctacatgatcgggcaaacaggaatccagcgaacagtcttcttcattctaatgatgttggtcgccccatcttacggaatgcgatgcgtaggagtagggaacagagactttgtagaaggagtctcaggtggagcatgggtcgatctggtgctagaacatggaggatgtgtcacaaccatggcccagggaaagccaaccttggattttgaactgattaagacaacagccaaggaagtggctctgttaagaacctattgcattgaagcttccatatcaaacataaccacagcaacaagatgtccaacgcaaggagagccttacctcaaagaggaacaagatcaacagtacatttgccggagagacatggtagatagagggtggggcaacggttgtggcttgtttgggaagggaggagttgtgacatgtgcgaagttttcatgcttggggaagataacgggcaacttagttcaaattgagaaccttgaatacacagtggttgtaacagtccacaatggagacactcacgctgtaggaaatgacacatctaaccatggagtgacagccacaataacccccaggtcaccatcggttgaagttcaattaccggactatggagaattgacactcgactgtgaacctaggtccggaattgactttaatgagatgattctgatgaaaatgaaaacgaaaacgtggctcgtgcacaagcaatggtttttggatctacctctaccatggacaacaggagcagacacgctagaagttcactggaatcacaaagagagaatggtgacattcaaggttcctcatgccaagagacaggacgtgacagtgctaggatctcaggaaggagccatgcattcagccctcgccggagccacagaagtggactccggtgatggaaaccatatgtttgcaggacacttaaagtgtaaagttcgtatggaaaagttgaggattaagggaatgtcatacacgatgtgctcaggaaagttctcaattgataaagagatggcagaaacacagcatggaacaacagtggtaaaggtcaagtatgagggtactggagctccatgtaaagttcccatagagataagagatgtgaacaaggaaaaagtggttgggcgcatcatctcatccaccccttttgctgagaataccaacagtgtgaccaatatagaattggaacctccttttggggatagctacatagtgataggtgtgggagacagtgcattaacactccattggttcaggaaagggagctccattggcaagatgtttgagtccacatacagaggtgcaaagcgcatggccattctaggtgaaacagcttgggattttggttccgttggtggactgctcacgtcattaggaaaggctgtacatcaagtttttggcagtgtgtacacaactatgtttggaggagtctcatggatggtcagaatcctaatcggactcttagtgttgtggattggtacgaattcaagaaacacttcaatggctatgtcgtgcatagctgttggaggaatcaccctgtttctgggcttcacagtccatgcagatatgggttgtgtggtgtcatggagtgggaaagagttgaaatgtggaagcggaatctttgtaattgacaacgtgcacacctggacagaacagtacaaatttcaaccagagtctccagcgcgactggcgtcggcaatactgaatgcccacaaagaaggggtctgtggaattagatcaaccacgaggctggaaaatgtcatgtggaaacaaataactaatgagttaaactatgttctctgggaaggaggacatgacctcactgtagtggccggggatgtgaaaggggtgctgtccaaaggcaagagagcactcgcacctccagtgaatgacctgaaatattcatggaagacatgggggaaagcaaagatctttactccagaaacaagaaacagcacgtttttggtggacggaccagacacctccgaatgccccaatgaacgaagagcatggaactttcttgaggtggaagactatggatttggcatgttcacgaccaacatatggatgaaatttcgagaaggaagttcagaagtgtgtgaccataggctgatgtcggcagcaatcaaagaccagaaagctgtgcatgctgacatgggctattggatagagagctcaaaaaaccagacctggcagatagagaaggcatccctcatagaagtgaaaacatgtctgtggcccaagacccacacattgtggagcaatggagtgctggaaagtcagatgctcatcccaaaagcatatgcaggccctatttcacagcacaactatcgccagggctatgccacgcagaccgcgggcccatggcacttgggcaaattggaaatagactttggagaatgccccggaacaacagtcactgtacaagaggattgtgaccatagaggcccatctttgagaaccaccactgcatctggaaaattggtcacgcagtggtgctgtcgctcctgcacgatgccccccttaagatttttaggagaggatggatgctggtatggaatggaaatcaggcccttgaatgaaaaagaagagaacatggtcaaatcacaggtttcagccggacatggcacatcagagactttttctatggggctgttgtgcctgactttgtttgtggaagaatgcttgaggagaagagtcaccaggaaacacatgatattggttgtggtgaccaccctttgtgccatcattttaggaggtcttacatggatggacttactgcgtgcccttatcatgctaggggacaccatgtctggtagaatggggggacagattcatctagccatcatggcagtgttcaagatgtcaccaggatacgtgttgggtatatttctgaggaaactcacctcaagagagacagcactgatggtaataggaatggccatgacaacggtgctttcaattccacatgaccttatggaattcattgatggaatatcattagggttaatcttattaaaaatggtaacacattttgacaacactcaagtgggaaccttagcccttgccttgacctttataaaatcaacaatgccattggtcatggcttggaggaccataatggctgtgttgtttgtggtcacactcattcctctatgtaggacaagctgtcttcaaaagcagtcccattgggtggaaataacagcactcatcctgggagcccaggctctgccagtatacctaatgactctcatgaaaggagcctcaaaaagatcttggccccttaacgagggtataatggctgtgggcttggtcagtctcttaggaagcgcccttctaaagaatgatgtccctttagctggcccaatggtggcaggaggcttacttctggcagcctacgtgatgagcggcagctcagcagacctgtcactggagaaggctgccaatgtgcagtgggatgagatggcagacataacaggctcaagcccaatcatagaagtgaagcaggatgaagatggttctttctccatacgggacgtcgaggaaaccaacatgattaccctcctggtgaaactggcactgataacagtgtcaggtctctaccccttggcaattccagtcacaatgaccctatggtacatgtggcaagtgaaaacacaaagatcaggagccctgtgggacgtcccctcacctgctgccgctcagaaagctacactgactgagggagtatacaggatcatgcaaagagggttgtttggaaaaacccaggttggagtagggatacacacggaaggtgtgtttcatacaatgtggcatgtaacaagaggatcagtgatttgtcatgagagtgggagactggagccatcttgggctgacgtcaggaacgacatgatatcatacggtgggggatggaggctcggagataaatgggataaagaagaagatgttcaagttctagctatagaaccaggaaaaaatccgaaacatgtccaaacgaaacccggcctcttcaaaacccttactggagaaattggagcagtaacattggacttcaaacccggaacatccggttctcccatcattaacaggaaaggaaaagtcattggactctacggaaatggggtagttaccaaatcaggtgattacgttagtgccataacacaagctgaaagaattggtgagccagactatgaagtggatgaggacattttccgaaagaaaagattaactataatggatttacatcccggagccggaaagacaaaaagaatcctcccatcaatagttagagaagccttaaaaaggaggctgcgaaccttgattctggctcccacgagagtggtggcggccgaaatggaagaagcgctacgtggactgccaatccgttatcagaccccagctgtgaaatcagaacacacaggaagagagatcgtagacctcatgtgtcatgcaacctttacaacaagacttttatcatcaaccagggttccaaattacaacctcatagtgatggatgaagcgcatttcacagacccttctagtgttgcagctagaggatatatctcaaccagagtggaaatgggagaggctgcagctgtttttatgactgcaacccctcctggaacgacagatcccttcccccagagcaacagcccaatagaagacatcgagagagaaatcccagaaaggtcatggaacacagggtttgactggataacggactaccaagggaaaactgtgtggtttgttcccagcataaaagctggaaatgacattgcaaattgcttgagaaaatcgggaaagaaggtcatccaattgagcaggaaaaccttcgatacagagtatccaaaaacgaaactcacggactgggattttgtgattaccacagacatatctgaaatgggggccaattttagagctgggagagtgatagaccccaggagatgtctcaagccagttatcttaactgatgggccagagagagttattttagctggtcccattccagtgactccagcaagcgccgctcagagaagagggcgaataggtaggaacccagcacaagaagatgaccagtatgtcttctccggagacccactaaggaatgatgaagatcatgcccactggactgaagcaaagatgcttcttgataatatctacaccccagaagggatcattccaacactgtttggtccagaaagggaaaaaacccaagccattgacggagagttccgcctcagaggggaacaaaggaagacctttgtagaactaatgaggagaggagaccttccggtgtggctgagccacaaggtagcttctgctggtatctcttacaaagaccgggaatggtgcttcacgggggaaaggaataaccaaattttggaagaaaacatagaggttgaaatttggactagggagggagagaagaaaaaactcaggccaaaatggttagatgcacgtgtttacgctgatcccatggctttgaaggatttcaaggagtttgccagtggaagaaagagcataaccctcgacatcttgacagaaatcgccagtctgccaacgtacctttcctccagggctaagctcgcccttgacaacatagtcatgctccatacaacagaaagaggagggaaggcctaccaacacgctctgaacgaactcccagagtcactagaaacactcatgcttgtagctttattaggagccatgacagcaggcatcttcctattcttcatgcaaggaaaaggaatgggaaaattgtcaatgggtctgatagccattgcggtagctagtggcttgctctgggtggcagaaatccagccccaatggatagcggcctcaatcatattggagttttttctcatggtgttgttggtaccagaaccagaaaaacaaaggaccccacaagacaatcaattgatctacgtcatattgaccattctcactattattgctctcgtggcagccaatgagatggggctaattgaaaaaacaaaaacggattttgggttttaccaggtgaaagcagaaaccaccatccttgatgtggacttgagaccagcttcagcatggacgctctatgcagtagctaccactatcttgacccccatgctgaggcacaccatagaaaacacgtctgcaaacttatccttggcggccattgccaaccaagcagccgtcctgatggggcttggaaaaggatggccgctccacagaatggacctcggtgtgccgctattggcaatgggatgctattcccaagtgaacccaacaactttaacagcatccttggtcatgcttctggtccattatgcaataataggtccaggattgcaggccaaagccacaagagaggctcaaaaaaggacagctgctgggatcatgaagaaccccacggtggacgggataacagttatagatctagaaccaatatcctatgacccaaaatttgagaagcagctggggcaagtcatgctactagttttgtgcgttggacagctactcttgatgagaacaacatgggccttttgtgaagtcttgactttggccacaggaccaatcttgaccttgtgggaaggcaacccgggaaggttttggaacacgacaatagccgtgtccactgccaacattttcaggggaagctacttggcgggagctggattggccttttcgctcataaagaatgcacaaacccccaggaggggaactgggaccatgggagagacactgggagaaaaatggaagagacagctaaactcgctagataggaaggagtttgaagagtacaaaagaagtggaatactagaagtggacaggactgaagccaggtctgccctaaaagatgggtccaaaatcaagtacgcagtgtccagaggtaccagcaagattagatggattgttgaaagagggatggtaaagccaaaagggaaagttgtggatcttggttgcggaaggggaggatggtcgtactatatggcgacactcaagaacgtgaccgaggtgaaagggtatacaaaaggaggtccaggacatgaggaaccgattcccatggctacctatggttggaacttggtcaaactccattcaggggttgacgtgttctacaaacccactgagcaagtggacactctgctctgtgatattggggagtcatcctctaatccgacgatagaggaaggaagaacattacgagttttaaagatggtggagccatggctctcttcaaaacctgaattctgcatcaaagtcctcaatccctacatgccaacagtcatagaggagctggagaaactgcagagacgacatggtggaagtcttgtcagatgcccgctatccaggaattccactcatgagatgtattgggtgtcaggtgtgtcaggaaacatcgtgagttctgtgaacacaacatcaaaaatgttgttgaacagatttaccacaaggcacaggaaacccacttatgagaaggacgcagaccttggagcaggaacgagaagtgtctccaccgaaacagaaaaaccagacatgacaatcatcgggagaagactccagcgattgcaagaagagcacaaagaaacttggcactatgatcatgaaaatccatacagaacctgggcgtatcatggaagctatgaagctccttcgacaggctcagcatcctccatggtgaacggggtagttaaactgttgacaaaaccctgggacgtggtaccaatggtgactcagttggccatgacagatacaaccccctttgggcaacagagagtgttcaaggagaaggttgacaccagaacaccacagccaaaaccaggtacacaagtagtcatgaccacgacagccaactggctgtggactctccttgggaggaagaaaaatcccagactgtgcacaagggaagaattcatctcaaaagttaggtcaaatgcagccataggcgcagtctttcaggaagaacagggatggacatcagccagtgaagcagtgaatgacagccggttttgggaactggttgacaaagaaagggctctgcaccaggaagggaaatgtgaatcatgcgtctataacatgatgggaaaacgtgaaaaaaaattgggagaatttggcagagccaagggaagccgagcaatctggtacatgtggctgggagcgcggtttctggaatttgaagccctgggctttttgaatgaagatcactggtttggcagggaaaactcatggagtggagtggaaggggaaggtctgcataggttgggatacatcttggaggacatagacaagaaggatggagatttgatatatgctgatgacacagcaggctgggacacaagaatcactgaagatgaccttctgaatgaagagctgatcacggaacagatgacccctcatcataaaatcctagctaaagccattttcaaactaacttatcaaaacaaagtggtaaaagtcctcagacccacaccgaaaggagcagtgatggacattatatccagaaaagatcaaagaggtagtggacaggttggaacatatggtttgaacacattcaccaacatggaagtacaactcatccgccaaatggaagctgaaggagtcattacacgagatgacatgcataacccaaaagggttgaaagaaagagttgagaaatggctgaaagagtgtggtgtcgacaggttaaagaggatggcaattagtggagacgattgtgtggtgaagcctctagatgagaggttcagcacttccctcctctttttgaacgacatgggaaaggtgaggaaagacattccgcaatgggaaccatccaagggatggaaaaactggcaagaggttcctttttgctcccaccattttcacaagatctttatgaaggatggccgttcactggtcgttccatgtagaaaccaggatgaactaatagggagagctagaatctcgcaaggggctggatggagtttaagagaaacggcctgtctgggcaaggcttacgcccagatgtggtcgctcatgtactttcatagaagggacctacgtttagcctccatggctatatgctcagcagtcccaacggaatggtttccaacaagtagaacaacatggtcaatccacgctcatcatcagtggatgactactgaagatatgctaaaagtgtggaacagagtatggatagaagacaaccctaacatgattgacaaaactccagttcactcgtgggaagacataccttacctagggaaaagagaggatttgtggtgtggatccttgattggactctcttctagggccacctgggctaagaacattcacacagccataacccaggtcaggaacctaattgggaaagaggaatatgtggattacatgccagccatgagaagatacagcgctcatttcgagagtgaaggagttctgtaa

SEQ ID NO: 7906 - RNA, 9867 nt, synthetic construct
  misc_feature 1..9867: note = derived and/or modified CDS sequence (wt) from DENV-4__KF907503__SS-prME
  source 1..9867: mol_type = other RNA
tcaacgataacattgctgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccatgataactcccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggaaggaggacatgacctcactgtagtggctggggatgtgaagggggtgttgaccaaaggcaagagagcactcacacccccagtgagtgatctgaaatattcatggaagacatggggaaaagcaaaaatcttcaccccagaagcaagaaatagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaagtcatatgcgggccctttttcacagcacaattaccgccagggctatgccacgcaaaccgtgggcccatggcacttaggcaaattagagatagactttggagaatgccccggaacgacagtcacaattcaggaggattgtgaccatagaggcccatctttgaggacctccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactgggactaattttgctaaaaatagtaacacagtttgacaacacccaagtgggaaccttagctctttccttgactttcataagatcaacaatgccattgatcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactctcatgaaaggagcctcaagaagatcttggcctcttaacgagggcataatggctgtgggtttggttagtctcttaggaagtgctcttttaaagaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccttgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattagatttcaaacccggaacgtctggttctcccatcatcaacaggaaaggaaaagtcatcggactttatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttatcagaccccagctgtgaaatcagaacacacaggaagagagattgtagacctcatgtgtcatgcaacctccacaacaagacttttgtcatcaaccagggttccaaattacaaccttatagtgatggatgaagcacatttcactgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaagaaataaccaaattttagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgataacatagtcatgctccacacaacagaaagaggagggagggcctatcaacacgccctgaacgaacttccggagtcactggaaacactcatgcttgtagctttgctaggtgctatgacagcaggtatcttcctgtttttcatgcaagggaaaggaatagggaaattgtcaatgggtttgataatcattgcggtggctagtggcttgctctgggtagcagaaattcaaccccagtggatagcggcctcaatcatactagagttttttctcatggtactgttgataccggaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgctttcagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctatgaagctccttcgacaggctctgcatcctccatggtgaacggggtagtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctagatgagaggttcggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 7907 - RNA, 9867 nt, synthetic construct
  misc_feature 1..9867: note = derived and/or modified CDS sequence (wt) from DENV-4__AY947539__SS-prME
  source 1..9867: mol_type = other RNA
tcaacaatgacattgctgtgcttgattcccaccgcaatggcgtttcacttgtcaacaagagatggcgaaccccttatgatagtggcaagacacgaaagggggagacctctcttgtttaagacaacagagggaatcaacaaatgcactcttattgccatggacctgggtgaaatgtgtgaggacaccgtcacgtatgaatgccctctactggtcaataccgaacctgaggacattgattgctggtgcaatctcacgtctgcctgggtcatgtatgggacatgcactcagagtggggaacggagacgggagaagcgctcagtagccctaacaccacattcaggaatgggattggagacaagggctgagacatggatgtcatcggaaggggcttggaaacatgctcagagggtagagagttggatactcagaaacccaggattcgctctcttggcaggatttatggcctatatgattgggcaaacaggaatccagcgaacagtcttctttgttctaatgatgctggtcgccccatcctacggaatgcgatgcgtgggagtggggaacagagactttgtggaaggagtctcaggtggagcatgggtcgatttggtgctagaacatggaggatgtgtcacaaccatggcccagggaaaaccaaccttggattttgaactgatcaagacaacagccaaggaagtggctctgttaagaacctattgcattgaagcctcgatatcaaacataaccacggcaacaagatgtccaacgcaaggagaaccttatctcaaagaggaacaagatcaacagtacatttgccggagagatgtggtagacagagggtggggcaatggctgtggcttgtttgggaaaggaggagttgtgacatgtgcgaagttttcatgctcggggaagataacaggcaatttggtccaaattgagaaccttgaatacacagtagttgtaacagtccacaatggagacacccatgcagtaggaaatgacatacccaaccatggagtgacagccacgataacccccaggtcaccatcggtagaagttaaattaccggattatggagaattaacactcgattgtgaacccaggtccggaattgattttaatgagatgattctgatgaaaatgaaaaagaaaacgtggcttgtgcacaagcaatggtttttggatctacctctaccatgggcagcaggagcagacacatcagaagttcattggaattacaaagagagaatggtgacattcaaggttcctcatgccaagagacaggatgtgacagtgctaggatctcaggaaggagccatgcattctgccctcaccggagctacagaagtggattccggtgatggaaaccacatgtttgcaggacatctgaaatgcaaagttcgcatggagaaattgagaattaagggaatgtcatacacgatgtgctcaggaaagttctcaattgacaaagagatggcagaaacacagcatgggacaacagtggtaaaagtcaagtatgagggtgctggagctccatgtaaagttcccatagagataagagatgtgaacaaggaaaaagtggtagggcgcatcatctcatctaccccttttgctgagtataccaacagtgtaaccaacatagaattagaacccccctttggggacagctacatagtaataggtgttggagacagtgcattaacactccattggttcaggaaagggagttccattggcaagatgcttgagtccacatacagaggcgcaaagcgaatggccattctaggtgaaacagcctgggattttggttctgttggtggactgctcacatcattgggaaaggctgtacaccaggtttttggtagtgtgtatacaactatgtttggaggagtctcatggatggttagaatcctaattgggttcttagtgttgtggattggcacgaattcgagaaacacctcaatggcaatgacgtgcatagctgttggaggaatcactctgtttctgggtttcacagttcacgcagacacgggttgtgcggtgtcatggagtgggaaagaattgaaatgtggaagcggaatctttgtaattgacaacgtgcacacttggacagaacagtacaaatttcaaccagagtctccagcgagactagcgtccgcaatattgaatgcccacgaagatggggtctgtggaattagatcaaccacgaggctggaaaacatcatgtggaagcaaataaccaacgagttgaactatgttctctgggaaggaggacatgacctcactgtagtggccggggatgtgaaaggggtgctgtccaaaggcaagagagcactcgcacccccagtgaatgatctgaaatattcatggaagacatggggaaaagcaaagatctttactccagaagcaaaaaatagcacatttctaatagacggaccagacacctccgaatgccccaatgaacgaagagcatggaattttcttgaggtagaagactatggatttggcatgtttacgaccaacatatggatgaaatttcgagaaggaagttcagaagtgtgtgaccacaggttgatgtcggcggcaatcaaagaccagaaagctgtgcatgctgacatgggctattggatagagagctcaaaaaaccagacctggcagatagagaaagcatctctcattgaagtgaaaacatgtctgtggcccaagacccacacattgtggagcaatggagtgctagagagccagatgctcatcccaaaagcatatgcaggccctttttcacagcacaattaccgccagggctatgccacgcagaccgtgggcccatggcacttgggcaaattggagatagactttggagaatgccccggaacaacagtcactattcaagaggattgtgaccatagaggcccatctttgaggaccactactgcatctggaaaattggtcacgcagtggtgctgccgctcctgcacgatgcctcccttaaggtttttgggagaggatggatgctggtatgggatggaaattaggcccttgagtgaaaaagaagagaacatggtcaaatcacaggtatcggccggacagggtacatcagaaactttttctatggggctgttatgcctgactttgtttgtggaagaatgcttgaggagaagagtcaccaggaaacacatgatattggttgtggtgaccaccctttgtgccatcatcctaggaggtctcacatggatggacttactacgagctcttatcatgttaggggacaccatgtctggtagaatgggaggacagattcacttagccatcatggcagtgttcaagatgtcaccaggatacgtgctgggtatatttttaaggaaactcacttcaagagagacagcactaatggtgataggaatggccatgacaacggtgctttcaattccacatgaccttatggaattcattgatggaatatcactggggttaatcttattaaaaatggtaacacattttgacaacactcaagtgggaaccttagctctttccttgactttcataagatcaacaatgccattggtcatggcttggaggaccataatggctgtgttgtttgtggtcacactcattcctttatgcaggacaagctgtcttcaaaagcagtcacattgggtagaaataacagcactcatcctgggagcccaggctctgccagtgtacctaatgactctcatgaaaggagcttcaaagagatcttggccccttaacgagggtataatggctgtgggtttggtcagtctcttgggaagcgccctcctaaagaatgatgtccctttagctggcccaatggtggcaggaggcttacttctggcagcctatgtgatgagtggtagctcagcagacctgtcactagagaaggccgccaatgtgcagtgggatgagatggcagacataacaggctcaagcccaatcatagaagtgaagcaggatgaagatggctctttctccatacgggacatcgaggaaaccaatatgataaccctcttagtgaaactggcactgataacagtgtcaggtctctaccccttggcaattccagtcacaatgaccctatggtacatgtggcaagtgaaaacacaaagatcaggagccctgtgggacgtcccctcacctgctgccgctcagaaagccacactgactgaaggagtgtacaggatcatgcaaagagggttgtttgggaaaactcaggttggagtagggatacacatggaaggtgtatttcacacaatgtggcatgtaacaagaggatcagtgatctgccatgagactgggagactggagccatcttgggctgacgtcaggaacgacatgatatcatacggtgggggatggaggctcggagacaaatgggacaaagaagaagatgttcaggttctagctatagaaccaggaaaaaatccgaaacatgtccaaacgaagcccggccttttcaaaaccctaactggagaaattggagcagtgacattggacttcaaacccggaacatctggttctcccatcattaacaggaaaggaaaagttatcggactctacggaaatggagtagtcactaaatcaggtgattacgtcagtgctataacgcaagccgaaagaactggtgagccagattatgaagtggatgaggacatttttcgaaagaaaagattaactataatggacttacaccccggagccggaaagacaaaaagaattctcccatcaatagtcagagaagccttaaaaaggaggctgcgaaccttgattttggctcccacgagagtggtggcggccgagatggaagaggccctacgtggactgccaatccgttatcagaccccagctgtgaaatcagaacacacaggaagagagatcgtagacctcatgtgtcatgcaaccttcacaacaagacttttatcatcaaccagggttccaaattacaacctcatagtgatggatgaagcacatttcacagacccttctagtgtcgcggctagaggatacatctcaaccagggtggaaatgggagaggcagcagccatctttatgactgcaacccctcctggagcgacagatcccttcccccagagcaacagcccaatagaagacatcgagagagaaattccagaaaggtcatggaacacagggttcgactggataaccgactaccaagggaaaactgtgtggtttgttcccagcataaaagctggaaatgacattgcaaattgcttgagaaagtcgggaaagaaggtgatccaattgagtagaaaaacctttgacacagagtatccaaaaacgaaacttacggactgggattttgtggttaccacagacatatcagaaatgggggccaattttagagctgggagagtgatagaccccaggagatgcctcaagccagttatctcaactgacgggccagagagagttattttggcaggtcccattccagtgactccagcaagcgctgctcagagaagagggcgaataggtaggaacccagcacaagaagatgaccaatatgtcttctccggagacccactaaaaaatgatgaagatcatgcccactggacagaagcaaagatgctgcttgataatatctacaccccggaagggatcattccaacattgtttggtccggaaagagaaaaaaatcaagccattgatggagagttccgcctcagaggggaacaaaggaagacttttgtagaattaatgaggagaggagaccttccggtgtggctgagctacaaggtagcttctgctggtatctcttacaaagaccgggaatggtgcttcacaggggaaaggaataaccaaattctagaagaaaacatggaggttgaaatttggactagagagggagagaagaaaaaactcaggccaaaatggttagatgcacgtgtttacgctgaccccatggctttgaaggatttcaaggagtttgccagtggaagaaagagcataaccctcgacatcctaacagagattgccagtttgccaacttacctttcctctagggctaagctcgcccttgacaacatagtcatgctccacacaacagaaagaggagggaaggcctaccaacatgccctgaacgaactcccggagtcactagaaacactcatgcttgtagctttactgggtgctatgacagcaggcatcttcttgtttttcatgcaaggaaaaggaatagggaaactgtcaatgggtttgatagccattgcggtagctagtggcttgctctgggtagcagaaatccagccccagtggatagcggcctcaatcatactagagttctttctcatggtgttgttgataccagaaccagaaaaacaaaggaccccacaagacaatcaattgatctacgtcatattgaccattctcaccattattggtctcatagcagccaacgagatggggctgattgaaaaaacaaaaacggattttgggttttaccaggtaaaaacagaaaccaccatcctcgatgtggatttgagaccagcctcagcatggacgctctatgcagtagccaccactattctgactcccatgctgagacacaccatagaaaacacgtctgcaaacctatctctagcggccattgctaaccaagcagctgtcctaatggggcttggaaaaggatggccgctccacagaatggacctcggtgtgccgctgttggcaatgggatgctattctcaagtgaacccaacgaccttgatagcatccttagtcatgcttttagtccattacgcaataataggtccaggactgcaggcaaaagccacaagagaggctcagaaaaggacagcagctgggatcatgaagaaccccactgtggacgggataacagtaatagatctagaaccaatatcctatgacccaaaatttgaaaagcaattagggcaagtcatgctactagtcttgtgtgctggacagctactcttgatgagaacaacatgggctttctgtgaagtcttgactttggccacaggaccagtcttgaccctgtgggagggcaacccgggaaggttttggaacacgactatagccgtgtccactgccaatattttcaggggaagctacttggcgggagctggactggccttttcgctcataaagaatgcacaaacccccaggaggggaactgggaccacaggagagacactgggagagaagtggaagagacagctaaactcactagataggaaggagtttgaagagtacaaaagaagtggaatactagaagtggacaggactgaagccaagtctgccttgaaagatggatctaaaatcaagcatgcagtgtccagagggtccagcaagattagatggattgttgaaagagggatggtaaaaccaaaagggaaagttgtggatcttggttgcgggagaggaggatggtcgtactacatggcgacactcaagaacgtgaccgaggtgaaagggtacacaaaaggaggtccaggacatgaagaaccgattcccatggctacctatggctggaacttggtcaaactccattcaggggttgacgtgttctacaaacccactgagcaagtggataccctgctctgtgatattggggagtcatcttctaatccgacgatagaggaaggaagaacattaagagttttgaagatggtggaaccatggctctcttcaaaacctgaattctgcatcaaagtccttaatccctacatgccaacagtcatagaagagctggagaaactgcagagaaaacatggtggaagtcttgtcagatgcccgctatctaggaattccactcacgagatgtattgggtgtcaggtgtgtcgggaaacatcgtgagctctgtaaacacaacatcaaagatgttgttgaacagatttaccacaaggcatagaaaacccacttatgagaaggacgtagaccttggagcaggaacgagaagtgtctccactgaaacagaaaaaccggacatgacaatcattgggagaaggcttcagcgactgcaagaagagcacaaagaaacttggcactatgatcaggaaaacccatacagaacctgggcgtatcatggaagctatgaagctccttcgacaggctcagcatcctccatggtgaacggggtagtaaaattgctgacaaaaccctgggacgtgattccaatggtgacccagttggctatgacagacacaaccccttttgggcaacagagagtgtttaaagagaaggtggacaccagaacaccacaaccaaaacccggcacacgaatggttatgaccacgacagccaactggctgtgggctctcctcgggaagaagaaaaatcccagactgtgcacaagggaagagttcatctcaaaagttaggtcaaacgcagccataggcgcagtctttcaggaagaacagggatggacatcagccagtgaagctgtgaatgacagccgattttgggaactggttgacaaagaaagggctctgcaccaggaagggaaatgtgaatcgtgtgtctacaacatgatgggaaaacgtgagaaaaagttaggagagtttggtagagccaagggaagccgagcaatctggtacatgtggctgggagcgcggtttctggaatttgaagccctgggttttttgaatgaagatcactggtttggcagagaaaactcatggagtggagtggaaggggaaggtctgcatagattgggatatatcctggaggacatagacaagaaggatggagacctgatatatgctgatgacacagctggttgggacacaagaatcactgaagatgaccttctaaatgaagaactgatcacggaacagatggcccctcaccataagatcctagccaaagccattttcaaactaacttatcaaaacaaagtggtgaaagtcctcagacccacaccgaaaggagcggtgatggatatcatatccaggaaagaccaaagaggtagtggacaggttggaacatatggtttgaacacattcaccaacatggaagtacaactcatccgccaaatggaagctgaaggagtcatcacacaagatgacatgcataacccaaaagggttgaaagaaagagttgagaaatggctgaaagagtgtggtgtcgacaggttaaagaggatggcaatcagtggagacgattgtgtggtgaagcctctggatgagaggttcagcacttccctcctctttttgaacgacatgggaaaggtgaggaaagacattccgcagtgggaaccatctaagggatggaaaaactggcaagaggttcctttttgctcccaccactttcacaagatcttcatgaaggatggccgctcactagttgttccatgtagaaaccaggatgaactgatagggagagccagaatctcgcaaggggctggatggagtttaagagaaacagcctgcctgggcaaagcttacgcccagatgtggtcgctcatgtactttcatagaagggacctgcgtttagcctccatggcgatatgctcagcagttccaacagaatggtttccaacaagcagaacaacatggtcaatccacgcccatcatcagtggatgaccactgaagatatgctcaaagtgtggaacagagtgtggatagaagacaaccctaatatgactgacaagactccagttcattcgtgggaagacataccttacctaggaaaaagagaagatttgtggtgtggatccttgattggactttcttccagggccacctgggcgaagaacattcacacagccataacccaggtcaggaacctgatcgggaaagaggagtatgtggattacatgccagtcatgaaaagatacagcgctcctttcgagagtgaaggagttctgtaa

SEQ ID NO: 7908 - RNA, 9879 nt, synthetic construct
  misc_feature 1..9879: note = derived and/or modified CDS sequence (opt1) from DENV-1__AB608789__SS-prME
  source 1..9879: mol_type = other RNA
agcgtgaccatgctgctcatgctgatgcccaccgccctggccttccacctcaccacccggggcggggagccccacatgatcgtgaccaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacatcgactgctggtgcaacgccacggacacctgggtgacctacgggacctgcagccagacgggcgagcaccggcgcgacaagcggagcgtggccctcgcgccccacgtgggcctggggctggagacccgcaccgagacctggatgtccagcgagggcgcctggaagcagatccagcgggtggagacgtgggccctccgccaccccgggttcaccgtcatcgccctgttcctggcgcacgccatcggcacctccatcacccagaaggggatcatcttcatcctcctgatgctggtgacgcccagcatggccatgcggtgcgtgggcatcggctcccgcgacttcgtcgaggggctcagcggcgccacctgggtggacgtggtcctggagcacgggtcctgcgtgaccaccatggccaaggacaagcccacgctggacatcgagctcctgaagaccgaggtgaccaaccccgcggtcctgcggaagctctgcatcgaggccaagatcagcaacaccacgaccgactcccgctgccccacccagggcgaggccaccctggtggaggagcaggacgccaacttcgtgtgccggcgcacgttcgtcgaccggggctgggggaacggctgcgggctgttcggcaaggggagcctcatcacgtgcgccaagttcaagtgcgtgaccaagctggagggcaagatcgtgcagtacgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagcgcgggtccagcatcggcaagatgttcgaggccaccgcccgcggggcccgccgcatggcgatcctgggcgacacggcctgggacttcgggtccatcggcggcgtgttcaccagcgtggggaagctggtccaccagatcttcggcaccgcctacggggtgctgttctccggcgtgagctggaccatgaagatcgggatcggcgtcctgctgacgtggctcggcctgaactcccggagcacctccctgagcatgacctgcatcgccgtggggctcgtgaccctgtacctgggcgtcatggtgcaggccgactccgggtgcgtgatcaactggaagggccgcgagctcaagtgcgggagcggcatcttcgtcacgaacgaggtgcacacctggaccgagcagtacaagttccaggcggacagcccgaagcggctgtccgccgccatcggcaaggcctgggaggagggggtgtgcggcatccgcagcgccacccggctggagaacatcatgtggaagcagatctccaacgagctcaaccacatcctgctggagaacgacatgaagttcaccgtcgtggtgggggacgtcgtgggcatcctcgcgcaggggaagaagatgatccgcccccagcccatggagtacaagtacagctggaagtcctggggcaaggccaagatcatcggcgccgacgtgcagaacacgaccttcatcatcgacgggcccaacaccccggagtgccccgacgaccagcgggcctggaacatctgggaggtcgaggactacggcttcgggatcttcaccacgaacatctggctgaagctgcgcgacagctacacccaggtgtgcgaccaccggctcatgtccgcggccatcaaggacagcaaggccgtgcacgccgacatgggctactggatcgagtccgagaagaacgagacctggaagctggcccgcgcgagcttcatcgaggtcaagacctgcatctggcccaagtcccacacgctgtggagcaacggcgtgctcgagtccgagatgatcatccccaagatctacgggggcccgatcagccagcacaactaccggcccgggtacttcacccagaccgccggcccctggcacctggggaagctggagctcgacttcgacctgtgcgagggcaccacggtggtcgtggacgagcactgcggcaaccgcgggccgtccctgcggaccaccaccgtgacgggcaagatcatccacgagtggtgctgccgcagctgcaccctgccgcccctccggttcaagggggaggacggctgctggtacgggatggagatccgccccgtcaaggagaaggaggagaacctggtgaagtccatggtgagcgccggcagcggcgaggtcgactccttcagcctcgggctgctgtgcatgtccatcatgatcgaggaggtgatgcggagccgctggtcccggaagatgctcatgaccggcaccctggccgtgttcctgctcctgatcatggggcagctgacgtggaacgacctcatccgcctgtgcatcatggtcggcgccaacgcgagcgaccgcatggggatgggcaccacctacctggccctcatggccaccttcaagatgcggccgatgttcgccgtgggcctgctgttccgccggctcacgtcccgcgaggtgctgctgctcaccatcgggctgagcctggtcgcctccgtggagctccccaacagcctggaggagctgggcgacgggctcgcgatgggcatcatgatcctgaagctgctcaccgacttccagtcccaccagctgtgggccaccctgctcagcctgacgttcatcaagaccaccgtctccctgcactacgcctggaagaccatggccatggtgctcagcatcgtgtccctgttccccctgtgcctcagcacgacctcccagaagaccacctggctgcccgtcctgctcggcagcctggggtgcaagccgctgacgatgttcctcatcgcggagaacaagatctggggccggaagtcctggcccctgaacgaggggatcatggccgtgggcatcgtgagcatcctgctcagctccctgctgaagaacgacgtccccctcgccgggcccctgatcgccggcggcatgctgatcgcctgctacgtgatcagcgggtccagcgcggacctctccctggagaaggccgccgaggtgagctgggaggaggaggccgagcactccggcgccagccacaacatcctggtcgaggtgcaggacgacgggaccatgaagatcaaggacgaggagcgcgacgacaccctcaccatcctgctgaaggcgaccctcctggccgtgtccggcgtctacccgctgagcatccccgccaccctcttcgtgtggtacttctggcagaagaagaagcagcggtccggggtgctgtgggacacccccagcccgcccgaggtcgagcgcgccgtgctggacgagggcatctaccggatcatgcagcgcggcctgctcgggcggtcccaggtgggcgtcggggtgttccaggagaacgtgttccacaccatgtggcacgtcacccgcggcgccgtgctgatgtaccaggggaagcggctggagcccagctgggcgtccgtgaagaaggacctcatcagctacggcggcgggtggcgcctgcagggctcctggaacacgggggaggaggtccaggtgatcgccgtggagcccggcaagaaccccaagaacgtccagaccgcccccgggaccttcaagacccccgagggcgaggtgggcgccatcgccctggacttcaagcccgggacgagcggctcccccatcgtgaaccgggaggggaagatcgtcggcctctacggcaacggggtggtgaccaccagcggcacctacgtcagcgcgatcgcccaggccaaggcctcccaggaggggccgctgcccgagatcgaggacgaggtgttccgcaagcggaacctgacgatcatggacctccaccccggcagcgggaagacccgccggtacctgccggcgatcgtgcgcgaggccatcaagcggaagctgcgcaccctcatcctggcccccacccgcgtcgtggcctccgagatggccgaggcgctgaagggcatgcccatccggtaccagacgaccgccgtcaagagcgagcacaccggcaaggagatcgtcgacctcatgtgccacgccaccttcacgatgcgcctgctgtcccccgtgcgggtgccgaactacaacatgatcatcatggacgaggcccacttcaccgaccccagctccatcgccgcgcgcgggtacatcagcacccgggtcggcatgggggaggccgccgccatcttcatgaccgccacgccgcccggctccgtggaggcgttcccgcagagcaacgccgtgatccaggacgaggagcgcgacatccccgagcggtcctggaacagcgggtacgagtggatcaccgacttccccggcaagaccgtctggttcgtgccctccatcaagagcggcaacgacatcgccaactgcctccgcaagaacgggaagcgggtgatccagctgtcccgcaagaccttcgacacggagtaccagaagaccaagaacaacgactgggactacgtcgtgaccaccgacatcagcgagatgggcgccaacttccgggcggaccgcgtgatcgacccgcggcgctgcctgaagcccgtcatcctcaaggacgggcccgagcgggtgatcctggccggccccatgccggtcacggtggcctccgccgcccagcgccgggggcgcatcggccggaaccacaacaaggagggcgaccagtacatctacatggggcagcccctgaacaacgacgaggaccacgcgcactggaccgaggccaagatgctcctggacaacatcaacacccccgagggcatcatccccgccctgttcgagccggagcgcgagaagtccgccgccatcgacggggagtaccgcctccggggcgaggcgcgcaagaccttcgtggagctgatgcggcgcggggacctgcccgtctggctctcctacaaggtggccagcgagggcttccagtacagcgaccggcgctggtgcttcgacggcgagcggaacaaccaggtgctggaggagaacatggacgtcgagatctggacgaaggagggggagcgcaagaagctgcggccccgctggctcgacgcccggacctactccgaccccctggccctgcgcgagttcaaggagttcgccgcgggccggcgcagcgtgtccggggacctcatcctggagatcggcaagctgccgcagcacctcacccagcgggcccagaacgccctggacaacctggtgatgctccacaacagcgagcagggcgggcgcgcctaccggcacgcgatggaggagctgcccgacaccatcgagacgctgatgctcctggccctgatcgccgtcctcaccggcggggtgaccctgttcttcctgtccggccgcgggctcggcaagaccagcatcggcctgctgtgcgtgatggcctccagcgtcctcctgtggatggcctccgtggagccccactggatcgcggccagcatcatcctggagttcttcctcatggtgctgctgatccccgagccggaccggcagcgcacgccccaggacaaccagctcgcctacgtcgtgatcgggctgctgttcatgatcctcacggtggccgccaacgagatgggcctgctggagaccaccaagaaggacctcgggatcggccacgtcgcggtggagaaccaccaccacgccaccatgctggacgtggacctgcaccccgcctccgcctggacgctctacgccgtcgcgaccaccatcatcaccccgatgatgcggcacacgatcgagaacaccaccgccaacatcagcctgaccgccatcgccaaccaggccgcgatcctgatggggctcgacaagggctggcccatctccaagatggacatcggcgtgcccctgctggccctcgggtgctacagccaggtgaaccccctgacgctgaccgccgccgtcctcatgctggtggcgcactacgccatcatcggcccggggctgcaggccaaggccacccgcgaggcccagaagcgcaccgcggccggcatcatgaagaaccccacggtggacgggatcgtcgccatcgacctcgaccccgtggtgtacgacgccaagttcgagaagcagctgggccagatcatgctgctcatcctgtgcacctcccagatcctgctcatgcggaccacctgggccctgtgcgagagcatcacgctggcgaccggccccctcaccaccctgtgggaggggtccccgggcaagttctggaacacgaccatcgccgtcagcatggccaacatcttccgcgggtcctacctggccggcgccggcctcgcgttcagcctgatgaagtccctcgggggcgggcggcgcgggaccggggcccagggcgagaccctcggcgagaagtggaagcggcagctgaaccagctgtccaagagcgagttcaacacgtacaagcgctccgggatcatggaggtggaccggagcgaggccaaggagggcgtgaagcgcggggagaccaccaagcacgccgtctcccggggcaccgcgaagctccgctggttcgtggagcggaacctggtgaagcccgaggggaaggtcatcgacctgggctgcggccgcgggggctggagctactactgcgccgggctgaagaaggtgacggaggtgaagggctacaccaagggcgggcccggccacgaggagcccatcccgatggccacctacgggtggaacctcgtcaagctgcactccggcaaggacgtgttcttcacgccgcccgagaagtgcgacacgctgctctgcgacatcggggagagctcccccaacccgaccatcgaggagggccggaccctgcgcgtgctgaagatggtcgagccctggctccgggggaaccagttctgcatcaagatcctgaacccctacatgcccagcgtggtggagaccctggagcagatgcagcgcaagcacggcggcatgctcgtccggaacccgctgtcccgcaacagcacccacgagatgtactgggtgtcctgcgggacgggcaacatcgtgagcgccgtcaacatgacctcccggatgctgctcaaccgcttcaccatggcccaccgcaagcccacctacgagcgggacgtggacctgggggcgggcacgcgccacgtggccgtcgagcccgaggtggccaacctggacatcatcggccagcggatcgagaacatcaagcacgagcacaagagcacctggcactacgacgaggacaacccctacaagacctgggcctaccacgggtcctacgaggtcaagccgagcggctccgccagcagcatggtgaacggggtggtcaagctcctgaccaagccctgggacgtgatccccatggtgacgcagatcgcgatgaccgacaccacccccttcggccagcagcgcgtcttcaaggagaaggtggacacgcggaccccgaaggccaagcgcgggaccgcccagatcatggaggtgaccgcccggtggctgtggggcttcctctcccgcaacaagaagccccggatctgcacgcgcgaggagttcacccggaaggtccgcagcaacgccgcgatcggcgccgtgttcgtggacgagaaccagtggaactccgccaaggaggccgtcgaggacgagcggttctgggacctggtgcaccgcgagcgggagctgcacaagcaggggaagtgcgcgacctgcgtgtacaacatgatgggcaagcgcgagaagaagctcggggagttcggcaaggcccccgagagccgggccatctggtacatgtggctgggggcccgcttcctggagttcgaggccctcggcttcatgaacgaggaccactggttctcccgggagaacagcctgtccggcgtcgagggggagggcctgcacaagctcgggtacatcctgcgcgacatcagcaagatcccgggcgggaacatgtacgcggacgacaccgccggctgggacacgcggatcaccgaggacgacctgcagaacgaggccaagatcaccgacatcatggagcccgagcacgccctcctggccacctccatcttcaagctgacgtaccagaacaaggtggtgcgcgtccagcgccccgcgaagaacggcaccgtgatggacgtgatcagccggcgcgaccagcgggggtccggccaggtcgggacctacggcctcaacaccttcacgaacatggaggcccagctgatccgccagatggagagcgagggcatcttctccagctccgagctggagacccccaacctcgccgagcgggtgctggactggctggggaagtacggcgtggagcgcctcaagcggatggccatcagcggggacgactgcgtcgtgaagccgatcgacgaccgcttcgccaccgcgctgaccgccctgaacgacgtgggcaaggtccggaaggacatcccccagtgggagccctccaaggggtggaacgactggcagcaggtccccttctgcagccaccacttccaccagctcatcatgaaggacggccgcgagatcgtggtcccgtgccggaaccaggacgagctggtgggccgcgcccgggtgagccagggggccggctggtccctgcgcgagacggcctgcctcggcaagagctacgcgcagatgtggcagctgatgtacttccaccggcgcgacctgcggctcgccgccaacgccatctgctccgcggtccccgtggactgggtgcccaccagccgcaccacctggtccatccacgcccaccaccagtggatgacgaccgaggacatgctgagcgtctggaaccgggtgtggatcgaggagaacccctggatggaggacaagacccacgtgtccagctggggcgacgtcccgtacctggggaagcgcgaggaccagtggtgcggctccctcatcggcctgaccgcccgcgccacctgggccacgaacatccaggtggcgatcaaccaggtgcggcgcctgatcgggaacgagaactacctcgactacatgaccagcatgaagcggttcaagaacgagtccgaccccgagggcgccctgtggtga

SEQ ID NO: 7909 - RNA, 9879 nt, synthetic construct
  misc_feature 1..9879: note = derived and/or modified CDS sequence (opt1) from DENV-1__AB608788__SS-prME
  source 1..9879: mol_type = other RNA
agcgtgaccatgctgctcatgctgctgcccaccgtgctcgccttccacctgaccacccggggcggggagccccacatgatcgtgaccaagcaggagcggggcaagagcctcctgttcaagaccagcgccggggtgaacatgtgcacgctgatcgcgatggacctgggcgagctctgcgaggacaccatgacctacaagtgcccccgcatcaccgaggccgagcccgacgacgtggactgctggtgcaacgccacggacacctgggtgacctacgggacctgcagccagacgggcgagcaccggcgggacaagcggagcgtggccctggcgccccacgtcggcctggggctcgagacccgcaccgagacctggatgtccagcgagggcgcctggaagcagatccagcgggtggagacgtgggccctgcgccaccccgggttcaccgtgatcgccctgttcctcgcccacgcgatcggcacctccatcacccagaaggggatcatcttcatcctgctgatgctcgtgacgcccagcatggccatgcggtgcgtgggcatcggcaaccgcgacttcgtggaggggctgtccggcgccacctgggtcgacgtggtgctggagcacgggagctgcgtcaccaccatggccaaggacaagcccacgctcgacatcgagctgctgaagaccgaggtgaccaaccccgccgtgctccggaagctgtgcatcgaggcgaagatctccaacaccacgaccgacagccgctgcccgacccagggcgaggccaccctggtcgaggagcaggacgccaacttcgtgtgccggcgcacgttcgtggaccggggctgggggaacggctgcggcctcttcggcaaggggtccctgatcacgtgcgccaagttcaagtgcgtcaccaagctggagggcaagatcgtgcagtacgagaacctcaagtacagcgtgatcgtcaccgtgcacacgggcgaccagcaccaggtcgggaacgagtccaccgagcacggcaccaccgccaccatcacgccccaggcgcccaccagcgagatccagctgaccgactacggggccctgaccctcgactgcagcccccggacgggcctggacttcaacgagatggtgctgctcaccatgaaggagaagtcctggctggtgcacaagcagtggttcctggacctcccgctgccctggacctccggggccaccacgagccaggagacctggaaccggcaggacctgctcgtcaccttcaagaccgcccacgccaagaagcaggaggtggtggtcctgggcagccaggagggcgcgatgcacacggccctgaccggggccaccgagatccagacctccggcacgaccaccatcttcgccgggcacctcaagtgccgcctgaagatggacaagctgaccctcaagggcatgagctacgtgatgtgcacggggtccttcaagctggagaaggaggtggccgagacccagcacggcaccgtcctggtccaggtgaagtacgagggcaccgacgcgccctgcaagatccccttcagcacgcaggacgagaagggggtcacccagaacggccgggtgatcaccgccaacccgatcgtgaccgacaaggagaagcccgtcaacatcgaggccgagccgcccttcggggagtcctacatcgtggtgggcgccggcgagaaggcgctgaagctcagctggttcaagaaggggtccacgatcggcaagatgttcgaggccaccgcccgcggggcccggcgcatggccatcctgggcgacaccgcgtgggacttcgggagcatcggcggcgtcttcacctccgtggggaagctggtgcaccagatcttcggcacggcctacggggtcctcttcagcggcgtgtcctggaccatgaagatcgggatcggcgtgctgctgacctggctcggcctgaacagccgctccaccagcctgtccatgacgtgcatcgccgtcgggctcgtgaccctgtacctgggcgtgatggtccaggccgacagcgggtacgtgatcaactggaagggccgggagctcaagtgcgggtccggcatcttcgtgaccaacgaggtccacacctggaccgagcagtacaagttccaggccgacagcccgaagcgcctgtccgcggccatcggcaaggcctgggaggagggggtgtgcggcatccggagcgccacgcgcctggagaacatcatgtggaagcagatcagcaacgagctcaaccacatcctgctggagaacgacatgaagttcaccgtggtcgtgggggacgtgtccggcatcctcgcccaggggaagaagatgatccggccccagcccatggagcacaagtacagctggaagtcctggggcaaggcgaagatcatcggcgccgacgtccagaacagcaccttcatcatcgacgggcccaacaccccggagtgccccgacgaccagcgcgcctggaacatctgggaggtggaggactacggcttcgggatcttcacgaccaacatctggctgaagctgcgggactcctacacccaggtgtgcgaccaccgcctcatgagcgccgcgatcaaggactccaaggccgtccacgccgacatgggctactggatcgagagcgagaagaacgagacctggaagctggcccgggcctccttcatcgaggtgaagacgtgcgtgtggcccaagagccacaccctgtggtccaacggcgtcctcgagagcgagatgatcatccccaagatctacgggggcccgatctcccagcacaactaccgccccgggtacttcacccagaccagcggcccctggcacctggggaagctggagctcgacttcgacctgtgcgagggcacgaccgtggtggtcgacgagcactgcggcaaccgggggccgtccctgcgcaccaccacggtgaccggcaagatcatccacgagtggtgctgccggagctgcaccctgccgcccctgcgcttcaagggggaggacggctgctggtacgggatggagatccggcccgtgaaggagaaggaggagaacctggtcaagtccatggtgagcgcgggcagcggcgaggtggactccttcagcctcgggctgctgtgcatctccatcatgatcgaggaggtcatgcgcagccggtggtcccgcaagatgctcatgaccggcacgctggccgtgttcctgctcctgatcatggggcagctgacctggaacgacctcatccggctgtgcatcatggtcggcgccaacgccagcgaccgcatggggatgggcaccacctacctggccctcatggcgacgttcaagatgcgcccgatgttcgccgtgggcctgctgttccggcgcctcacctcccgggaggtgctgctgctcaccatcgggctgagcctggtcgcctccgtggagctccccaacagcctggaggagctgggcgacgggctcgccatgggcatcatgatcctgaagctgctcaccgacttccagtcccaccagctgtgggccgcgctgctcagcctgacgttcatcaagaccaccttctccctgcactacgcctggaagaccatggccatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggccgcaagtcctggcccctgaacgaggggatcatggcggtgggcatcgtcagcatcctgctcagctccctgctgaagaacgacgtgcccctcgccgggcccctgatcgccggcggcatgctgatcgcctgctacgtgatcagcgggtccagcgccgacctctccctggagaaggcggccgaggtcagctgggaggaggaggccgagcactccggcgccagccacaacatcctggtggaggtgcaggacgacgggaccatgaagatcaaggacgaggagcgggacgacaccctcaccatcctgctgaaggccaccctcctggcggtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacccggggcgccgtgctgatgtaccaggggaagcgcctggagcccagctgggcctccgtcaagaaggacctcatcagctacggcggcgggtggcggctgcagggctcctggaacacgggggaggaggtccaggtgatcgcggtcgagcccggcaagaaccccaagaacgtgcagaccgcccccgggaccttcaagacccccgagggcgaggtgggcgccatcgccctggacttcaagcccgggacgagcggctcccccatcgtcaaccgcgaggggaagatcgtgggcctctacggcaacggggtggtcaccaccagcggcacctacgtgagcgccatcgcgcaggccaaggcctcccaggaggggccgctgcccgagatcgaggacgaggtgttccggaagcgcaacctgacgatcatggacctccaccccggcagcgggaagacccggcgctacctgccggccatcgtccgggaggcgatcaagcgcaagctgcggaccctcatcctggcccccacccgcgtggtggcctccgagatggccgaggccctgaagggcatgcccatccgctaccagacgaccgcggtcaagagcgagcacaccggcaaggagatcgtggacctcatgtgccacgccaccttcacgatgcggctgctgtcccccgtgcgcgtcccgaactacaacatgatcatcatggacgaggcccacttcaccgaccccagctccatcgccgcccgggggtacatcagcacccgcgtgggcatgggggaggcggccgccatcttcatgaccgccacgccgcccggctccgtggaggccttcccgcagagcaacgcggtcatccaggacgaggagcgggacatccccgagcgctcctggaacagcgggtacgactggatcaccgacttccccggcaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtcaccaccgacatcagcgagatgggcgccaacttccgcgccgaccgggtgatcgacccgcgccggtgcctgaagcccgtgatcctcaaggacgggcccgagcgcgtcatcctggcgggccccatgccggtgacggtggcctccgccgcccagcggcgcgggcggatcggccgcaaccagaacaaggagggcgaccagtacatctacatggggcagcccctgaacaacgacgaggaccacgcccactggaccgaggcgaagatgctcctggacaacatcaacacccccgagggcatcatccccgccctgttcgagccggagcgggagaagtccgccgccatcgacggggagtaccgcctccgcggcgaggcccggaagaccttcgtcgagctgatgcgccgcggggacctgcccgtgtggctctcctacaaggtggcgagcgagggcttccagtacagcgaccgccggtggtgcttcgacggcgagcgcaacaaccaggtcctggaggagaacatggacgtggagatctggacgaaggagggggagcggaagaagctgcgcccccggtggctcgacgcccgcacctactccgaccccctggccctgcgggagttcaaggagttcgccgccggccgccggagcgtgtccggggacctcatcctggagatcggcaagctgccgcagcacctcacccagcgcgcgcagaacgccctggacaacctggtcatgctccacaacagcgagcagggcgggcgggcctaccgccacgccatggaggagctgcccgacaccatcgagacgctgatgctcctggcgctgatcgccgtgctcaccggcggggtgaccctgttcttcctgtccggccgggggctcggcaagaccagcatcggcctgctgtgcgtcatggcctccagcgtgctcctgtggatggcctccgtggagccccactggatcgccgcgagcatcatcctggagttcttcctcatggtcctgctgatccccgagccggaccgccagcggacgccccaggacaaccagctcgcctacgtggtgatcgggctgctgttcatgatcctcacggtcgccgccaacgagatgggcctgctggagaccaccaagaaggacctcgggatcggccacgtggccgtggagaaccaccaccacgcgaccatgctggacgtcgacctgcaccccgcctccgcctggacgctctacgccgtggccaccaccatcatcaccccgatgatgcgccacacgatcgagaacaccaccgcgaacatcagcctgaccgccatcgccaaccaggccgccatcctgatggggctcgacaagggctggcccatctccaagatggacatcggcgtgcccctgctggcgctcgggtgctacagccaggtcaaccccctgacgctgaccgccgccgtgctcatgctggtggcccactacgcgatcatcggcccggggctgcaggccaaggccacccgggaggcccagaagcgcaccgccgcgggcatcatgaagaaccccacggtcgacgggatcgtggccatcgacctcgaccccgtggtctacgacgccaagttcgagaagcagctgggccagatcatgctgctcatcctgtgcacctcccagatcctgctcatgcgcaccacctgggccctgtgcgagagcatcacgctggccaccggccccctcaccaccctgtgggaggggtccccgggcaagttctggaacacgaccatcgcggtgagcatggccaacatcttccgggggtcctacctggccggcgccggcctcgccttcagcctgatgaagtccctcgggggcgggcgccgggggaccggggcgcagggcgagaccctcggcgagaagtggaagcgccagctgaaccagctgtccaagagcgagttcaacacgtacaagcggtccgggatcatcgaggtggaccgcagcgaggccaaggagggcctcaagcgcggggagaccaccaagcacgccgtctcccgcggcaccgccaagctgcggtggttcgtggagcgcaacctggtgaagcccgaggggaaggtcatcgacctgggctgcggccgcggcgggtggagctactactgcgcggggctcaagaaggtgacggaggtgaaggggtacaccaagggcggggccggccacgaggagcccatccccatggccacctacgggtggaacctggtcaagctgtactccggcaaggacgtgttcttcaccccgcccgagaagtgcgacacgctcctgtgcgacatcggggagagctcccccaaccccaccatcgaggagggccgcaccctgcgggtgctcaagatggtcgagccgtggctgcgcgggaaccagttctgcatcaagatcctgaacccctacatgcccagcgtggtggagaccctcgagcagatgcagcggaagcacggcggcatgctggtccgcaaccccctgtcccggaacagcacccacgagatgtactgggtgtcctgcgggacgggcaacatcgtgagcgccgtcaacatgacctcccgcatgctcctgaaccggttcaccatggcccaccgcaagccgacctacgagcgcgacgtggacctgggggcgggcacgcggcacgtcgccgtggagcccgaggtggccaacctcgacatcatcggccagcgcatcgagaacatcaagcacgagcacaagagcacctggcactacgacgaggacaacccctacaagacctgggcctaccacgggtcctacgaggtcaagcccagcggctccgccagcagcatggtgaacggggtggtccggctgctgaccaagccgtgggacgtgatccccatggtgacgcagatcgcgatgaccgacaccacccccttcggccagcagcgcgtcttcaaggagaaggtggacacgcggacccccaaggccaagcaggggaccgcccaggtgatggaggtcaccgcccgctggctctggggcttcctgtcccggaacaagaagccgcgcatctgcacgcgggaggagttcacccgcaaggtgcggagcaacgccgcgatcggcgccgtgttcgtcgacgagaaccagtggaactccgccaaggaggccgtggaggacgagcgcttctgggacctggtgcaccgggagcgcgagctccacaagcaggggaagtgcgcgacctgcgtctacaacatgatgggcaagcgggagaagaagctgggggagttcggcaaggccaaggggagccgcgccatctggtacatgtggctgggcgcccggttcctcgagttcgaggccctgggcttcatgaacgaggaccactggttctcccgcgagaacagcctgtccggggtggagggcgaggggctccaccggctgggctacatcctgcgcgacatcagcaagatccccgggggcaacatgtacgcggacgacaccgccggctgggacacgcggatcaccgaggacgacctccagaacgaggccaagatcaccgacatcatggagcccgagcacgccctgctggccacctccatcttcaagctcacgtaccagaacaaggtggtccgcgtgcagcgcccggcgaagaacgggaccgtgatggacgtcatcagccggcgcgaccagcggggctccggccaggtgggcacctacggcctgaacaccttcacgaacatggaggcccagctgatccgccagatggagagcgaggggatcttctcccccagcgagctcgagacccccaacctggccgagcgggtgctggactggctcgagaagtacggcgtcgagcgcctgaagcggatggccatctccggggacgactgcgtggtgaagcccatcgacgaccgcttcgccaccgcgctgaccgccctcaacgacatgggcaaggtccggaaggacatcccgcagtgggagcccagcaaggggtggaacgactggcagcaggtccccttctgctcccaccacttccaccagctgatcatgaaggacggccgcgagatcgtggtcccctgccggaaccaggacgagctggtgggccgcgcccgggtgagccagggggccggctggagcctccgcgagacggcctgcctggggaagtcctacgcgcagatgtggcagctgatgtacttccaccggcgcgacctccggctggccgccaacgccatctgcagcgcggtcccggtggactgggtgcccacctcccgcaccacctggagcatccacgcccaccaccagtggatgacgaccgagaacatgctgtccgtctggaaccgggtgtggatcgaggagaacccctggatggaggacaagacccacgtgagctcctgggaggacgtcccctacctcggcaagcgcgaggaccagtggtgcgggagcctgatcggcctgaccgcccgcgccacctgggccacgaacatccaggtggcgatcaaccaggtgcggcgcctcatcggcaacgagaactacctggactacatgacctccatgaagcggttcaagaacgacagcgacccggagggggccctgtggtga

SEQ ID NO: 7910 - RNA, 9879 nt, synthetic construct
  misc_feature 1..9879: note = derived and/or modified CDS sequence (opt1) from DENV-1__AB608786__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccacggacacctgggtgacctacgggacctgcagccagacgggcgagcaccggcgcgacaagcggtccgtggccctcgcgccccacgtgggcctggggctggagacccgcaccgagacctggatgagctccgagggcgcgtggaagcagatccagcgggtcgagacgtgggccctccgccaccccgggttcaccgtgatcgccctgttcctggcccacgtgatcggcaccagcatcacccagaaggggatcatcttcatcctcctgatgctggtcacgccctccctcgcgatgcggtgcgtgggcatcggcagccgcgacttcgtggaggggctgtccggcgccacctgggtcgacgtggtgctggagcacgggagctgcgtcaccaccatggccaaggacaagcccacgctcgacatcgagctgctgaagaccgaggtgaccaaccccgccgtgctccggaagctgtgcatcgaggccaagatctccaacaccacgaccgacagccgctgcccgacccagggcgaggcgaccctggtcgaggagcaggacgccaacttcgtgtgccggcgcacgttcgtggaccggggctgggggaacggctgcgggctgttcggcaaggggtccctgatcacgtgcgccaagttcaagtgcgtcaccaagctggagggcaagatcgtgcagtacgagaacctcaagtacagcgtgatcgtcaccgtgcacacgggcgaccagcaccaggtcgggaacgagtccaccgagcacggcaccaccgccaccatcacgccccaggcccccaccaccgagatccagctgaccgactacggggcgctgacgctcgactgcagcccccgcaccggcctggacttcaacgagatggtgctgctcaccatgaaggagaagtcctggctggtgcacaagcagtggttcctggacctccccctgccctggaccagcggggccagcacgtcccaggagacctggaaccggcaggacctgctcgtcaccttcaagaccgcccacgccaagaagcaggaggtggtggtcctgggcagccaggagggcgccatgcacacggcgctgaccggggccaccgagatccagacctccggcacgaccaccatcttcgccgggcacctcaagtgccgcctgaagatggacaagctgaccctcaagggcatgagctacgtgatgtgcacggggtccttcaagctggagaaggaggtggccgagacccagcacggcaccgtcctggtgcagatcaagtacgagggcaccgacgccccctgcaagatccccttcagcacgcaggacgagaagggggtgacccagaacggccggctgatcaccgcgaacccgatcgtcaccgacaaggagaagcccgtgaacatcgaggccgagccgcccttcggggagtcctacatcatcatcggcgccggcgagaaggccctcaagctgagctggttcaagaaggggtccagcatcggcaagatgttcgaggcgacggcccgcggggcccggcgcatggccatcctgggcgacaccgcctgggacttcgggtccatcggcggcgtgttcaccagcgtcgggaagctcgtgcaccagatcttcggcaccgcgtacggggtgctgttctccggcgtcagctggacgatgaagatcgggatcggcgtgctgctcacctggctgggcctgaactcccgcagcacctccctcagcatgacctgcatcgccgtggggctggtcacgctgtacctcggcgtgatggtgcaggccgactccgggtgcgtcatcaactggaagggccgggagctgaagtgcgggagcggcatcttcgtgaccaacgaggtgcacacctggaccgagcagtacaagttccaggccgacagcccgaagcgcctgtccgccgcgatcggcaaggcctgggaggagggggtctgcggcatccggagcgccacccgcctcgagaacatcatgtggaagcagatctccaacgagctgaaccacatcctgctcgagaacgacatgaagttcacggtggtggtcggggacgtggccggcatcctggcccaggggaagaagatgatccggccccagcccatggagtacaagtacagctggaagtcctggggcaaggcgaagatcatcggcgccgacgtgcagaacaccaccttcatcatcgacgggcccaacaccccggagtgccccgacgaccagcgcgcctggaacatctgggaggtcgaggactacggcttcgggatcttcacgaccaacatctggctgaagctccgggacagctacacccaggtgtgcgaccaccgcctgatgtccgccgcgatcaaggacagcaaggccgtgcacgccgacatgggctactggatcgagtccgagaagaacgagacctggaagctggcccgggccagcttcatcgaggtcaagacgtgcatctggcccaagtcccacaccctctggagcaacggcgtgctggagtccgagatgatcatccccaagatctacgggggcccgatcagccagcacaactaccgccccgggtacttcacccagaccgcgggcccctggcacctggggaagctcgagctggacttcgacctgtgcgagggcacgaccgtggtcgtggacgagcactgcggcaaccgggggccgtccctccgcaccaccacggtgaccggcaagatcatccacgagtggtgctgccggagctgcaccctgccgcccctgcgcttccgcggggaggacggctgctggtacgggatggagatccgccccgtcaaggagaaggaggagaacctcgtgaagtccatggtgagcgccggcagcggcgaggtcgactccttcagcctggggctgctctgcatctccatcatgatcgaggaggtgatgcggagccgctggtcccggaagatgctgatgaccggcacgctggccgtgttcttcctcctgatcatggggcagctgacctggaacgacctcatccgcctgtgcatcatggtcggcgccaacgccagcgaccgcatggggatgggcaccacctacctggcgctcatggccacgttcaagatgcggccgatgttcgccgtgggcctgctgttccgccggctcacctcccgcgaggtgctgctgctcaccatcgggctgagcctggtcgcctccgtggagctccccaacagcctggaggagctgggcgacgggctcgccatgggcatcatgatcctgaagctgctcaccgacttccagtcccaccagctgtgggcgacgctgctcagcctgaccttcatcaagaccaccttctccctgcactacgcctggaagacgatggccatggtcctcagcatcgtgtccctgttccccctgtgcctcagcaccacctcccagaagaccacgtggctgcccgtgctgctcggcagcctggggtgcaagccgctgaccatgttcctcatcgccgagaacaagatctggggccggaagtcctggcccctgaacgaggggatcatggcggtcggcatcgtgagcatcctgctcagctccctgctgaagaacgacgtgcccctcgccgggcccctgatcgccggcggcatgctgatcgcctgctacgtcatcagcgggtccagcgccgacctctccctggagaaggcggccgaggtgagctgggaggaggaggccgagcactccggcgccagccacaacatcctggtggaggtccaggacgacgggaccatgaagatcaaggacgaggagcgcgacgacaccctcaccatcctgctgaaggccacgctcctggcggtgtccggcgtgtacccgctgagcatccccgccaccctcttcgtctggtacttctggcagaagaagaagcagcggtccggggtgctgtgggacacccccagcccgcccgaggtggagcgcgccgtcctggacgacggcatctaccggatcatgcagcgcggcctgctcgggcggtcccaggtgggcgtgggggtcttccaggagaacgtgttccacaccatgtggcacgtgacgcgcggcgccgtcctgatgtaccaggggaagcggctggagcccagctgggcctccgtgaagaaggacctcatcagctacggcggcgggtggcgcctgcagggctcctggaacaccggggaggaggtgcaggtcatcgcggtggagcccggcaagaaccccaagaacgtgcagaccgcccccgggaccttcaagacgcccgagggcgaggtcggcgccatcgccctggacttcaagcccgggaccagcggctcccccatcgtgaaccgggaggggaagatcgtgggcctctacggcaacggggtcgtgaccaccagcggcacgtacgtgagcgccatcgcgcaggccaaggcctcccaggaggggccgctgcccgagatcgaggacgaggtcttccgcaagcggaacctgaccatcatggacctccaccccggcagcgggaagacccgccggtacctgccggccatcgtgcgcgaggcgatcaagcggaagctgcgcaccctcatcctggcccccacgcgcgtggtcgcctccgagatggccgaggccctgaagggcatgcccatccggtaccagaccaccgcggtcaagagcgagcacaccggcaaggagatcgtggacctcatgtgccacgccacgttcaccatgcgcctgctgtcccccgtccgggtgccgaactacaacatgatcatcatggacgaggcccacttcaccgaccccagctccatcgccgcccgcgggtacatcagcacccgggtgggcatgggggaggcggccgccatcttcatgacggccacgccgcccggctccgtcgaggccttcccgcagagcaacgcggtgatccaggacgaggagcgcgacatccccgagcggtcctggaacagcgggtacgagtggatcaccgacttccccggcaagaccgtgtggttcgtcccctccatcaagagcggcaacgacatcgccaactgcctccgcaagaacgggaagcgggtgatccagctgtcccgcaagacgttcgacaccgagtaccagaagaccaagaacaacgactgggactacgtggtcaccacggacatcagcgagatgggcgccaacttccgggccgaccgcgtgatcgacccgcggcgctgcctgaagcccgtgatcctcaaggacgggcccgagcgggtcatcctggcgggccccatgccggtgaccgtcgcctccgccgcccagcgccgggggcgcatcggccggaaccacaacaaggagggcgaccagtacatctacatggggcagcccctgaacaacgacgaggaccacgcccactggaccgaggcgaagatgctcctggacaacatcaacacccccgagggcatcatccccgccctgttcgagccggagcgcgagaagtccgccgccatcgacggggagtaccgcctccggggcgaggcccgcaagacgttcgtggagctgatgcggcgcggggacctgcccgtgtggctctcctacaaggtcgcgagcgagggcttccagtacagcgaccggcgctggtgcttcgacggcgagcggaacaaccaggtgctggaggagaacatggacgtggagatctggaccaaggagggggagcgcaagaagctgcggccccgctggctcgacgcccggacctactccgaccccctggccctgcgcgagttcaaggagttcgccgccggccggcgcagcgtctccggggacctcatcctggagatcggcaagctgccgcagcacctcacccagcgggcgcagaacgccctggacaacctggtgatgctccacaacagcgagcagggcgggcgcgcctaccggcacgccatggaggagctgcccgacacgatcgagaccctgatgctcctggcgctgatcgccgtgctcaccggcggggtcaccctgttcttcctgtccggccgcgggctcggcaagaccagcatcggcctgctgtgcgtgatggcctccagcgtgctcctgtggatggcctccgtcgagccccactggatcgccgcgagcatcatcctggagttcttcctcatggtgctgctgatccccgagccggaccggcagcgcacgccccaggacaaccagctcgcctacgtggtcatcgggctgctgttcatgatcctcaccgtggccgccaacgagatgggcctgctggagaccaccaagaaggacctcgggatcggccacgtggccgtcgagaaccaccaccacgcggccatgctggacgtggacctgcaccccgcctccgcctggacgctctacgccgtggcgaccaccatcatcaccccgatgatgcggcacacgatcgagaacaccaccgccaacatcagcctgaccgccatcgccaaccaggccgcgatcctgatggggctcgacaagggctggcccatctccaagatggacatcggcgtccccctgctggccctcgggtgctacagccaggtgaaccccctgacgctgaccgccgccgtgctcatgctggtcgcgcactacgccatcatcggcccggggctgcaggccaaggccacccgcgaggcccagaagcgcaccgcggccggcatcatgaagaaccccacggtggacgggatcgtggccatcgacctcgaccccgtcgtgtacgacgccaagttcgagaagcagctgggccagatcatgctgctcatcctgtgcacctcccagatcctgctcatgcggaccacctgggccctgtgcgagagcatcacgctggcgaccggccccctcaccaccctgtgggaggggtccccgggcaagttctggaacacgaccatcgccgtgagcatggccaacatcttccgcgggtcctacctggccggcgccggcctcgcgttcagcctgatgaagtccctcgggggcgggcggcgcgggaccggggcccagggcgagaccctcggcgagaagtggaagcggcagctgaaccagctgtccaagagcgagttcaacacgtacaaggggtccggcatcatggaggtcgaccgcagcgaggccaaggaggggctcaagcggggcgagaccaccaagcacgccgtgtcccgcgggaccgcgaagctgcggtggttcgtggagcgcaacctggtcaagcccgagggcaaggtgatcgacctgggctgcgggcggggcgggtggagctactactgcgccggcctcaagaaggtgacggaggtcaaggggtacaccaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgacgatcgaggaggggcgcaccctgcgggtcctcaagatggtggagccctggctgcgcggcaaccagttctgcatcaagatcctgaacccctacatgcccagcgtggtcgagaccctcgagcagatgcagcggaagcacggcgggatgctggtgcgcaacccgctgtcccggaacagcacccacgagatgtactgggtgtcctgcggcaccgggaacatcgtcagcgccgtgaacatgacgtcccgcatgctcctgaaccggttcaccatggcccaccgcaagcccacctacgagcgcgacgtggacctgggcgcgggcacccggcacgtcgccgtggagcccgaggtggccaacctcgacatcatcgggcagcgcatcgagaacatcaagcacgagcacaagagcacgtggcactacgacgaggacaacccctacaagacctgggcctaccacggctcctacgaggtcaagccgagcgggtccgccagcagcatggtgaacggcgtcgtgaagctgctgaccaagccctgggacgtgatccccatggtcacccagatcgcgatgacggacaccacccccttcgggcagcagcgggtgttcaaggagaaggtggacacccgcacgccgaaggccaagcggggcaccgcccagatcatggaggtcaccgccaagtggctctggggcttcctgtcccgcaacaagaagccccggatctgcacccgcgaggagttcacgcggaaggtgcgcagcaacgccgcgatcggggccgtgttcgtcgacgagaaccagtggaactccgccaaggaggccgtggaggacgagcggttctgggacctggtgcaccgcgagcgggagctccacaagcagggcaagtgcgcgacctgcgtctacaacatgatggggaagcgcgagaagaagctgggcgagttcgggaaggccaagggcagccgggccatctggtacatgtggctgggcgcccgcttcctcgagttcgaggccctggggttcatgaacgaggaccactggttctcccgggagaacagcctgtccggcgtggagggggagggcctccacaagctggggtacatcctgcgcgacatcagcaagatccccggcggcaacatgtacgcggacgacaccgccgggtgggacacccggatcacggaggacgacctccagaacgaggccaagatcaccgacatcatggagccggagcacgccctgctggccaagtccatcttcaagctcacctaccagaacaaggtggtccgcgtgcagcggcccgcgaagaacggcaccgtgatggacgtcatcagccgccgcgaccagcgggggtccggccaggtgggcacgtacgggctgaacaccttcaccaacatggaggcccagctgatccgccagatggagagcgagggcatcttctcccccagcgagctcgagacccccaacctggccgagcgggtgctggactggctcgagaagtacggggtcgagcgcctgaagcggatggccatctccggcgacgactgcgtggtgaagccgatcgacgaccgcttcgccacggcgctgaccgccctcaacgacatggggaaggtccggaaggacatcccccagtgggagcccagcaagggctggaacgactggcagcaggtccccttctgctcccaccacttccaccagctgatcatgaaggacggccgcgagatcgtggtcccgtgccggaaccaggacgagctggtggggcgcgcccgggtgagccagggcgccgggtggagcctccgcgagaccgcctgcctgggcaagtcctacgcgcagatgtggcagctgatgtacttccaccggcgcgacctccggctggccgccaacgccatctgcagcgcggtccccgtggactgggtgcccacctcccgcacgacctggagcatccacgcccaccaccagtggatgaccaccgaggacatgctgtccgtctggaaccgggtgtggatcgaggagaacccctggatggaggacaagacgcacatcagctcctggggcgacgtgccgtacctcggcaagcgcgaggaccagtggtgcggcagcctgatcgggctgaccgcccgggccacctgggccaccaacatccaggtcgcgatcaaccaggtgcgccgcctcatcggcaacgagaactacctggactacatgacctccatgaagcggttcaagaacgagagcgaccccgagggggccctgtggtga

SEQ ID NO: 7911 - RNA, 9879 nt, synthetic construct
  misc_feature 1..9879: note = derived and/or modified CDS sequence (opt1) from DENV-1__AB608787__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccggcgaccagcaccaggtggggaacgagtccacggagcacggcaccaccgcgaccatcacgccccaggcccccacgaccgagatccagctgaccgactacggggccctgaccctcgactgcagcccccgcacgggcctggacttcaacgagatggtcctgctcaccatgaaggagaagtcctggctggtgcacaagcagtggttcctggacctccccctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggccgactccgggtgcgtcatcaactggaagggccgggagctgaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctcgagaacatcatgtggaagcagatctccaacgagctgaaccacatcctgctcgagaacgacatgaagttcaccgtggtggtcggggacgtggcgggcatcctggcccaggggaagaagatgatccggccccagcccatggagcacaagtacagctggaagtcctggggcaaggccaagatcatcggcgccgacgtgcagaacagcacgttcatcatcgacgggcccaacaccccggagtgccccgacgaccagcgcgcgtggaacatctgggaggtcgaggactacggcttcgggatcttcaccaccaacatctggctgaagctccgggactcctacacccaggtgtgcgaccaccgcctgatgagcgccgccatcaaggactccaaggccgtgcacgccgacatgggctactggatcgagagcgagaagaacgagacctggaagctggcgcgggcctccttcatcgaggtcaagacctgcatctggcccaagagccacaccctctggtccaacggcgtgctggagagcgagatgatcatccccaagatctacgggggcccgatctcccagcacaactaccgccccgggtacttcacgcagaccgccggcccctggcacctggggaagctcgagctggacttcgacctgtgcgagggcaccaccgtggtcgtggacgagcactgcggcaaccgggggccgagcctccgcacgaccaccgtgaccggcaagatcgtccacgagtggtgctgccggtcctgcacgctgccgcccctgcgcttccgcggggaggacggctgctggtacgggatggagatccgccccgtgaaggagaaggaggagaacctcgtcaagagcatggtcagcgccggctccggcgaggtggacagcttctccctggggctgctctgcatcagcatcatcatcgaggaggtgatgcggtcccgctggatccggaagatgctgatgaccggcaccctgggggtcttcttcctcctgatcatgggccagctgacctggaacgacctcatccgcctgtgcatcatggtgggggccaacgcgagcgaccgcatgggcatgggcacgacctacctggccctcatggccaccttcaagatgcggccgatgttcgccgtggggctgctgttccgccggctcacctcccgcgaggtcctgctgctcacgatcggcctgagcctggtggcctccgtcgagctccccaacagcctggaggagctgggggacggcctcgcgatgggcatcatgatcctgaagctgctcaccgacttccagtcccaccagctgtgggccaccctgctcagcctgaccttcatcaagacgaccttctccctgcactacgcctggaagaccatggccatggtgctcagcatcgtgtccctgttccccctgtgcctcagcaccacgtcccagaagaccacctggctgcccgtcctgctcgggagcctgggctgcaagccgctgaccatgttcctcatcgcggagaacaagatctgggggcggaagtcctggcccctgaacgagggcatcatggccgtggggatcgtgagcatcctgctcagctccctgctgaagaacgacgtccccctcgccggccccctgatcgccggcgggatgctgatcgcctgctacgtgatcagcggctccagcgcggacctctccctggagaaggccgccgaggtgagctgggaggaggaggccgagcactccggggccagccacaacatcctggtcgaggtgcaggacgacggcacgatgaagatcaaggacgaggagcgcgacgacaccctcaccatcctgctgaaggcgaccctcctggccgtgtccggggtctacccgctgagcatccccgccaccctcttcgtgtggtacttctggcagaagaagaagcagcggtccggcgtgctgtgggacacgcccagcccgcccgaggtcgagcgcgccgtgctggacgacggcatctaccggatcatgcagcgcgggctgctcggccggtcccaggtgggggtcggcgtgttccaggagaacgtgttccacaccatgtggcacgtcacccgcggggccgtgctgatgtaccagggcaagcggctggagcccagctgggcgtccgtgaagaaggacctcatcagctacggcgggggctggcgcctgcaggggtcctggaacaccggcgaggaggtccaggtgatcgccgtggagcccgggaagaaccccaagaacgtccagacggcccccggcaccttcaagacccccgagggcgaggtgggggccatcgccctggacttcaagcccggcaccagcgggtcccccatcgtgaaccgggagggcaagatcgtcggcctctacgggaacggcgtggtgacgaccagcgggacctacgtcagcgcgatcgcccaggccaaggcctcccaggagggcccgctgcccgagatcgaggacgaggtgttccgcaagcggaacctgaccatcatggacctccaccccgggagcggcaagacgcgccggtacctgccggcgatcgtgcgcgaggccatcaagcggaagctgcgcaccctcatcctggcccccacccgcgtcgtggcctccgagatggccgaggcgctgaagggcatgcccatccggtaccagaccacggccgtcaagagcgagcacaccgggaaggagatcgtcgacctcatgtgccacgccaccttcaccatgcgcctgctgtcccccgtgcgggtgccgaactacaacatgatcatcatggacgaggcccacttcacggaccccagctccatcgccgcgcgcggctacatcagcacccgggtcgggatgggcgaggccgccgccatcttcatgaccgccacgccgcccgggtccgtggaggcgttcccgcagagcaacgccgtgatccaggacgaggagcgcgacatccccgagcggtcctggaacagcggctacgagtggatcacggacttccccggcaagaccgtctggttcgtgccctccatcaaggccgggaacgacatcgccaactgcctccgcaagaacggcaagcgggtgatccagctgagccgcaagaccttcgacaccgagtaccagaagacgaagaacaacgactgggactacgtcgtgaccaccgacatctccgagatgggggcgaacttccgggccgaccgcgtgatcgacccgcggcgctgcctgaagcccgtcatcctcaaggacggccccgagcgggtgatcctggccgggcccatgccggtcaccgtggccagcgccgcgcagcgccggggccgcatcggccggaaccacaacaaggagggggaccagtacatctacatgggccagcccctgaacaacgacgaggaccacgcccactggacggaggccaagatgctcctggacaacatcaacacccccgaggggatcatccccgccctgttcgagccggagcgcgagaagtccgccgcgatcgacggcgagtaccgcctccgcggggaggcccgcaagaccttcgtggagctgatgcggcgcggcgacctgcccgtctggctcagctacaaggtggcctccgagggcttccagtacagcgaccggcgctggtgcttcgacggggagcggaacaaccaggtgctggaggagaacatggacgtcgagatctggaccaaggagggcgagcgcaagaagctgcggccccgctggctcgacgcccggacgtacagcgaccccctggccctgcgcgagttcaaggagttcgcggccgggcggcgctccgtgagcggcgacctcatcctggagatcggcaagctgccgcagcacctcacccagcgggcccagaacgccctggacaacctggtgatgctccacaactccgagcagggcgggcgcgcgtaccggcacgccatggaggagctgcccgacaccatcgagaccctgatgctcctggccctgatcgccgtcctcaccgggggcgtgaccctgttcttcctgagcgggaagggcctcggcaagacctccatcgggctgctgtgcgtgatggccagctccgtcctcctgtggatggcgagcgtggagccccactggatcgccgcctccatcatcctggagttcttcctcatggtgctgctgatccccgagccggaccgccagcggacgccccaggacaaccagctcgcctacgtcgtgatcggcctgctgttcatgatcctcaccgtggccgcgaacgagatggggctgctggagacgaccaagaaggacctcggcatcgggcacgtcgccgtggagaaccaccaccacgccgccatgctggacgtggacctgcaccccgccagcgcgtggaccctctacgccgtcgccaccacgatcatcaccccgatgatgcgccacaccatcgagaacaccacggccaacatctccctgaccgccatcgcgaaccaggccgccatcctgatgggcctcgacaagggctggcccatcagcaagatggacatcggggtgcccctgctggccctcggctgctactcccaggtgaaccccctgaccctgaccgcggccgtcctcatgctggtggcccactacgccatcatcgggccgggcctgcaggccaaggcgacgcgggaggcccagaagcgcaccgccgccgggatcatgaagaaccccaccgtggacggcatcgtcgccatcgacctcgaccccgtggtgtacgacgcgaagttcgagaagcagctgggccagatcatgctgctcatcctgtgcaccagccagatcctgctcatgcgcacgacctgggccctgtgcgagtccatcaccctggccaccgggcccctcacgaccctgtgggagggcagcccggggaagttctggaacaccaccatcgccgtctccatggccaacatcttccggggcagctacctggcgggcgccgggctcgccttctccctgatgaagtccctgggcgggggccgccgggggacgggcgcccagggcgagaccctcggggagaagtggaagcgccagctgaaccagctgagcaagtccgagttcaacacctacaagggcagcgggatcatggaggtggaccggtccgaggcgaaggagggcctcaagcgcggggagaccacgaagcacgccgtgagccggggcaccgccaagctgcgctggttcgtcgagcggaacctggtgaagcccgagggcaaggtgatcgacctggggtgcggccgcgggggctggtcctactactgcgccgggctcaagaaggtcaccgaggtgaagggctacaccaagggcgggcccggccacgaggagcccatcccgatggccacgtacgggtggaacctggtgaagctgcacagcggcaaggacgtcttcttcatcccgcccgagaagtgcgacaccctcctgtgcgacatcggggagtccagccccaacccgaccatcgaggagggccggaccctgcgcgtgctcaagatggtggagccctggctgaagggcaaccagttctgcatcaagatcctgaacccctacatgccctccgtcgtggagacgctcgagcagatgcagcggaagcacgggggcatgctggtgcgcaacccgctgagccggaactccacccacgagatgtactgggtcagctgcgggaccggcaacatcgtgtccgcggtgaacatgaccagccgcatgctcctgaaccggttcaccatggcccaccgcaagcccacgtacgagcgggacgtcgacctgggcgccgggacccgccacgtggccgtggagcccgaggtcgccaacctcgacatcatcggccagcgcatcgagaacatcaagcacgagcacaagtccacctggcactacgacgaggacaacccctacaagacctgggcgtaccacgggagctacgaggtgaagccgtccggcagcgcctccagcatggtcaacggggtggtgaagctgctgacgaagccctgggacgtcatccccatggtgacccagatcgccatgaccgacaccacgcccttcggccagcagcgggtgttcaaggagaaggtcgacacccgcaccccgaaggccaagcggggcaccgcccagatcatggaggtgacggcgcgctggctctggagcttcctgtcccggaacaagaagccccgcatctgcacccgggaggagttcacccgcaaggtgcggagcaacgccgccatcggggccgtcttcgtggacgagaaccagtggaactccgcgaaggaggccgtggaggacgagcgcttctgggacctggtccaccgggagcgcgagctccacaagcagggcaagtgcgcgacctgcgtgtacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtggagggggagggcctccacaagctggggtacatcctgcgggacatcagcaagatccccggcggcaacatgtacgccgacgacacggccgggtgggacacccgcatcaccgaggacgacctccagaacgaggccaagatcaccgacatcatggagccggagcacgcgctgctggccaagtccatcttcaagctcacgtaccagaacaaggtcgtgcgggtgcagcgccccgccaagaacggcaccgtcatggacgtgatcagccggcgcgaccagcgcgggtccggccaggtgggcacctacgggctgaacaccttcacgaacatggaggcccagctgatccggcagatggagagcgagggcatcttctcccccagcgagctcgagacccccaacctggccgagcgcgtcctggactggctcgagaagtacggggtggagcggctgaagcgcatggcgatctccggcgacgactgcgtggtcaagccgatcgacgaccggttcgccaccgccctgaccgccctcaacgacatggggaaggtgcgcaaggacatcccccagtgggagcccagcaagggctggaacgactggcagcaggtccccttctgctcccaccacttccaccagctgatcatgaaggacggccgggagatcgtcgtgccgtgccgcaaccaggacgagctggtggggcgggcccgcgtcagccagggcgcggggtggagcctccgggagacggcctgcctgggcaagtcctacgcccagatgtggcagctgatgtacttccaccgccgggacctccgcctggccgcgaacgccatctgcagcgccgtgcccgtggactgggtccccacctcccggaccacctggagcatccacgcccaccaccagtggatgacgaccgaggacatgctgtccgtgtggaaccgcgtgtggatcgaggagaacccctggatggaggacaagacccacatcagctcctgggaggacgtcccgtacctcgggaagcgggaggaccagtggtgcggcagcctgatcggcctgaccgcccgccccacgtgggcgaccaacatccaggtggccatcaaccaggtgcggcgcctcatcgggaacgagaactacctggactacatgacctccatgaagcgcttcaagaacgagagcgagcccgagggcgccctgtggtga

SEQ ID NO: 7912 - RNA, 9879 nt, synthetic construct
  misc_feature 1..9879: note = derived and/or modified CDS sequence (opt1) from DENV-1__HE795086__SS-prME
  source 1..9879: mol_type = other RNA
agcgtgaccatgctgctcatgctgatgcccaccgccctggccttccacctcacgacccggggcggggagccccacatgatcgtgagcaagcaggagcggggcaagagcctgctgttcaagaccagcgccggggtgaacatgtgcaccctcatcgccatggacctgggcgagttctgcgaggacaccatgacctacaagtgcccccgcatcaccgaggccgagcccgacgacgtggactgctggtgcaacgccaccgacacgtgggtgacctacgggacctgcagccagaccggcgagcaccggcgggacaagcggtccgtggccctggcgccccacgtgggcctcgggctggagacgcgcaccgagacctggatgagctccgagggcgcctggaagcagatccagcgggtggagacctgggccctgcgccaccccgggttcacggtgatcgccctcttcctggcgcacgccatcggcaccagcatcacccagaaggggatcatcttcatcctgctcatgctggtgaccccctccatggccatgcggtgcgtcggcatcggcagccgcgacttcgtggaggggctgtccggcgccacgtgggtggacgtcgtgctcgagcacgggagctgcgtgaccaccatggccaaggacaagcccaccctggacatcgagctgctcaagacggaggtcaccaaccccgcggtgctgcggaagctgtgcatcgaggccaagatctccaacaccaccacggacagccgctgcccgacccagggcgaggccaccctcgtggaggagcaggacgccaacttcgtctgccggcgcaccttcgtggaccggggctgggggaacggctgcgggctgttcggcaaggggtccctgatcacgtgcgccaagttcaagtgcgtgaccaagctcgagggcaagatcgtccagtacgagaacctgaagtacagcgtgatcgtgaccgtccacaccggcgaccagcaccaggtggggaacgagtccacggagcacggcaccaccgcgaccatcacgccccaggcccccagcacggagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggaccagcggggcctccaccagccaggagacctggaaccggaaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctcgtccagatcaagtacgagggcaccgacgccccctgcaagatccccttctccacccaggacgagaagggggtgacccagaacggccggctgatcacggccaacccgatcgtgaccgacaaggagaagcccgtcaacatcgaggccgagccgcccttcggggagagctacatcgtgatcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtcgggaagctggtgcaccagatcttcggcaccgcctacggggtgctgttcagcggcgtctcctggaccatgaagatcgggatcggcgtgctcctgacctggctgggcctcaacagccgctccacgagcctgtccatgacctgcatcgccgtggggctggtcaccctctacctgggcgtgatggtgcaggccgacagcgggtgcgtcatcaactggaagggccgggagctgaagtgcgggagcggcatcttcgtgaccaacgaggtgcacacgtggaccgagcagtacaagttccaggcggactccccgaagcgcctcagcgccgccatcggcaaggcctgggaggagggggtctgcggcgtgcggtccgccacccgcctggagaacatcatgtggaagcagatcagcaacgagctgaaccacatcctcctggagaacgacatgaagttcaccgtggtcgtgggggacgtggcgggcatcctggcccaggggaagaagatgatccggccccagcccatggagtacaagtactcctggaagtcctggggcaaggccaagatcatcggcgccgacgtccagaacaccacgttcatcatcgacgggcccaacaccccggagtgccccgacgaccagcgcgcgtggaacatctgggaggtggaggactacggcttcgggatcttcaccaccaacatctggctcaagctgcgggactcctacacccaggtgtgcgaccaccgcctgatgagcgccgccatcaaggactccaaggccgtccacgccgacatgggctactggatcgagagcgagaagaacgagacctggaagctcgcgcgggcctccttcatcgaggtgaagacctgcatctggcccaagagccacaccctgtggtccaacggcgtgctggagagcgagatgatcatccccaagatctacgggggcccgatctcccagcacaactaccgccccgggtacttcacgcagaccgccggcccctggcacctcgggaagctggagctggacttcgacctctgcgagggcaccaccgtcgtggtggacgagcactgcggcaaccgggggccgagcctgcgcacgaccaccgtcaccggcaagatcatccacgagtggtgctgccggtcctgcacgctgccgcccctgcgcttcaagggggaggacggctgctggtacgggatggagatccggcccgtgaaggagaaggaggagaacctggtcaagagcatggtcagcgccggctccggcgaggtggacagcttctccctggggctcctgtgcatcagcatcatgatcgaggaggtgatgcgctcccggtggagccgcaagatgctgatgaccggcaccctcgccgtcttcttcctgctgatcatggggcagctcacctggaacgacctgatccggctgtgcatcatggtgggcgcgaacgcctccgaccgcatggggatgggcacgacctacctcgccctgatggccaccttcaagatgcgcccgatgttcgccgtgggcctcctgttccggcgcctgaccagccgggaggtcctgctcctgacgatcgggctgtccctcgtggcgagcgtcgagctgcccaactccctggaggagctcggcgacgggctggccatgggcatcatgatcctgaagctcctgaccgacttccagagccaccagctgtgggccaccctcctgtccctgaccttcatcaagacgaccttcagcctccactacgcctggaagaccatggcgatggtgctgtccatcgtgagcctgttccccctctgcctgtccaccacgagccagaagaccacctggctgcccgtcctcctgggctccctggggtgcaagccgctcaccatgttcctgatcgccgagaacaagatctggggccgcaagagctggcccctgaacgaggggatcatggccgtgggcatcgtgagcatcctcctgtccagcctgctcaagaacgacgtccccctggccgggcccctgatcgccggcggcatgctcatcgcgtgctacgtgatctccgggagctccgccgacctgagcctggagaaggccgccgaggtgtcctgggaggaggaggccgagcacagcggcgcgtcccacaacatcctcgtcgaggtgcaggacgacgggacgatgaagatcaaggacgaggagcgggacgacaccctgaccatcctgctcaaggccaccctgctggccgtgagcggcgtctacccgctctccatccccgccaccctgttcgtgtggtacttctggcagaagaagaagcagcgcagcggggtgctgtgggacacgcccagcccgcccgaggtcgagcgggccgtgctcgacgacggcatctaccgcatcatgcagcggggcctgctggggcgcagccaggtgggcgtcggggtgttccaggagaacgtgttccacaccatgtggcacgtcacccggggcgcggtgctgatgtaccaggggaagcgcctcgagccctcctgggccagcgtgaagaaggacctgatctcctacggcggcgggtggcggctgcagggcagctggaacaccggggaggaggtccaggtgatcgccgtggagcccggcaagaaccccaagaacgtccagacggcccccgggaccttcaagacctccgagggcgaggtgggcgccatcgcgctcgacttcaagcccgggaccagcggcagccccatcgtgaaccgcgaggggaagatcgtcggcctgtacggcaacggggtggtgacgacctccggcacctacgtcagcgccatcgcccaggccaaggcgtcccaggacgggcccctgccggagatcgaggacgaggtgttccggaagcgcaacctcaccatcatggacctgcaccccggcagcgggaagacgcggcgctacctgcccgccatcgtgcgggaggccatcaagcgcaagctccggaccctgatcctggccccgacccgcgtcgtggcctccgagatggcggaggccctcaagggcatgcccatccgctaccagaccacggccgtcaagagcgagcacaccggcaaggagatcgtcgacctgatgtgccacgccaccttcaccatgcggctgctctcccccgtgcgcgtgcccaactacaacatgatcatcatggacgaggcccacttcacggacccgagctccatcgcggcccgggggtacatcagcacccgcgtcggcatgggggaggccgccgccatcttcatgaccgcgacgccgcccggctccgtggaggccttcccccagagcaacgccgtgatccaggacgaggagcgggacatcccggagcgctcctggaacagcgggtacgagtggatcacggacttccccggcaagaccgtctggttcgtgccctccatcaagagcggcaacgacatcgccaactgcctgcggaagaacgggaagcgcgtgatccagctgtcccggaagaccttcgacaccgagtaccagaagacgaagaacaacgactgggactacgtcgtgaccaccgacatcagcgagatgggcgcgaacttccgcgccgaccgggtgatcgacccccgccggtgcctcaagccggtcatcctgaaggacgggcccgagcgcgtgatcctggccggccccatgcccgtcaccgtggcctccgccgcgcagcggcgcgggcggatcggccgcaaccacaacaaggagggcgaccagtacatctacatggggcagccgctcaacaacgacgaggaccacgcccactggacggaggccaagatgctgctggacaacatcaacacccccgagggcatcatccccgccctcttcgagcccgagcgggagaagtccgccgcgatcgacggggagtaccgcctgcgcggcgaggcccggaagaccttcgtggagctgatgcgccgcggggacctcccggtctggctgagctacaaggtggcctccgagggcttccagtacagcgaccgccggtggtgcttcgacggcgagcgcaacaaccaggtgctggaggagaacatggacgtcgagatctggaccaaggagggggagcggaagaagctccgcccccggtggctggacgcccgcacgtactccgaccccctggccctccgggagttcaaggagttcgcggccggccgccggagcgtgtccggggacctgatcctggagatcggcaagctcccccagcacctgacccagcgcgcccagaacgccctggacaacctcgtgatgctgcacaacagcgagcagggcgggcgggcgtaccgccacgccatggaggagctgccggacaccatcgagaccctcatgctgctggccctcatcgccgtcctgacgggcggggtgaccctgttcttcctctccggccgggggctgggcaagaccagcatcggcctgctctgcgtgatggcctccagcgtcctgctgtggatggcgtccgtggagccccactggatcgccgccagcatcatcctcgagttcttcctgatggtgctgctcatccccgagcccgaccgccagcggaccccgcaggacaaccagctggcctacgtcgtgatcgggctcctcttcatgatcctgaccgtggccgcgaacgagatgggcctgctcgagacgaccaagaaggacctggggatcggccacgtcgccgtggagaaccaccaccacgccgccatgctggacgtggacctccaccccgcctccgcgtggaccctgtacgccgtcgccaccacgatcatcacccccatgatgcgccacaccatcgagaacaccacggccaacatcagcctgaccgccatcgcgaaccaggccgccatcctcatggggctggacaagggctggccgatctccaagatggacatcggcgtgcccctgctcgccctggggtgctacagccaggtgaaccccctgaccctcaccgcggccgtcctgatgctggtggcccactacgccatcatcggccccgggctccaggccaaggcgacgcgggaggcccagaagcgcaccgccgccggcatcatgaagaacccgaccgtggacgggatcgtcgccatcgacctggaccccgtggtgtacgacgcgaagttcgagaagcagctgggccagatcatgctcctgatcctgtgcacctcccagatcctcctgatgcgcacgacctgggccctgtgcgagagcatcaccctcgccaccggccccctgacgaccctgtgggaggggtcccccggcaagttctggaacaccaccatcgccgtcagcatggccaacatcttccgggggagctacctcgcgggcgccggcctggccttctccctgatgaagtccctcgggggcgggcgccggggcacgggggcccagggcgagaccctgggcgagaagtggaagcgccagctgaaccagctctccaagagcgagttcaacacctacaagcggtccgggatcatggaggtggaccgcagcgaggcgaaggagggcctgaagcgcggggagaccacgaagcacgccgtgtcccgcggcaccgccaagctgcggtggttcgtcgagcgcaacctcgtgaagccggaggggaaggtgatcgacctgggctgcggccgcggcgggtggagctactactgcgccgggctgaagaaggtcaccgaggtgaaggggtacaccaagggcgggcccggccacgaggagcccatccccatggccacgtacgggtggaacctggtgaagctccactccggcaaggacgtcttcttcatcccgcccgagaagtgcgacaccctgctgtgcgacatcggggagagctcccccaaccccaccatcgaggagggccgcaccctccgggtgctgaagatggtggagccgtggctgcgcgggaaccagttctgcatcaagatcctcaacccctacatgcccagcgtcgtggagacgctggagcagatgcagcggaagcacggcggcatgctggtgcgcaaccccctctcccggaacagcacccacgagatgtactgggtctcctgcgggaccggcaacatcgtgagcgcggtgaacatgacctcccgcatgctgctgaaccggttcaccatggcccaccgcaagccgacgtacgagcgcgacgtcgacctcggggccggcacccggcacgtggccgtggagcccgaggtcgccaacctggacatcatcggccagcgcatcgagaacatcaagtacgagcacaagagcacctggcactacgacgaggacaacccctacaagacctgggcgtaccacgggtcctacgaggtgaagcccagcggcagcgcctccagcatggtcaacggggtggtgaagctgctcacgaagccgtgggacgtcatccccatggtgacccagatcgccatgaccgacaccacgcccttcggccagcagcgggtgttcaaggagaaggtcgacacccgcacccccaaggccaagcgggggaccgcccagatcatggaggtgacggcgaagtggctgtggggcttcctgtcccgcaacaagaagccgcggatctgcacccgcgaggagttcacccggaaggtgcgcagcaacgccgccatcggcgccgtcttcgtggacgagaaccagtggaactccgcgaaggaggccgtggaggacgagcggttctgggacctcgtccaccgcgagcgggagctgcacaagcaggggaagtgcgcgacctgcgtgtacaacatgatgggcaagcgcgagaagaagctgggggagttcggcaaggccaaggggagccgggccatctggtacatgtggctcggcgcgcgcttcctggagttcgaggccctgggcttcatgaacgaggaccactggttctcccgggagaacagcctctccggggtggagggcgaggggctgcacaagctgggctacatcctccgcgacatcagcaagatccccgggggcaacatgtacgccgacgacacggccggctgggacacccggatcaccgaggacgacctgcagaacgaggccaagatcaccgacatcatggagcccgagcacgcgctgctcgccaagtccatcttcaagctgacgtaccagaacaaggtcgtgcgcgtgcagcggccggccaagaacgggaccgtcatggacgtgatcagccgccgcgaccagcggggctccggccaggtgggcacctacggcctgaacaccttcacgaacatggaggcccagctcatccgccagatggagagcgaggggatcttctcccccagcgagctggagacccccaacctggccggccgggtcctcgactggctggagaagcacggggtggagcgcctgaagcggatggcgatctccggcgacgactgcgtggtcaagcccatcgacgaccgcttcgccaccgccctcaccgccctgaacgacatggggaaggtgcggaaggacatcccgcagtgggagcccagcaagggctggaacgactggcagcaggtccccttctgcagccaccacttccaccagctgatcatgaaggacggccgcgagatcgtcgtgccctgccggaaccaggacgagctcgtggggcgcgcccgggtctcccagggcgcggggtggagcctgcgcgagacggcctgcctgggcaagtcctacgcccagatgtggcagctcatgtacttccaccggcgcgacctgcggctggccgcgaacgccatctgcagcgccgtgccggtggactgggtccccacctcccgcaccacctggagcatccacgcccaccaccagtggatgacgaccgaggacatgctctccgtgtggaaccgggtgtggatcgaggagaacccctggatggaggacaagacccacatcagctcctgggaggacgtcccctacctggggaagcgcgaggaccagtggtgcggcagcctgatcggcctcaccgcccgggcgacgtgggccaccaacatccaggtggccatcaaccaggtgcgccgcctgatcgggaacgagaactacctggactacatgacctccatgaagcggttcaagaacgagagcgacccggagggcgccctctggtga

SEQ ID NO: 7913 - RNA, 9879 nt, synthetic construct
  misc_feature 1..9879: note = derived and/or modified CDS sequence (opt1) from DENV-1__AB189120__SS-prME
  source 1..9879: mol_type = other RNA
agcgtgaccatgctgctcatgctgctgcccaccgtgctcaccttccacctgaccacccgcggcggggagccccacatgatcgtgagcaagcaggagcggggcaagagcctcctgttcaagacctccgccggggtgaacatgtgcaccctgatcgccatggacctgggcgagctctgcgacgacaccatgacctacaagtgcccccgcatcaccgagaccgagcccgacgacgtggactgctggtgcaacgcgaccgagacctgggtgacctacgggacgtgcagccagaccggcgagcaccggcgcgacaagcggtccgtggccctggcgccccacgtcggcctggggctcgagacccgcaccgagacgtggatgagctccgagggcgcctggcggcagatccagaaggtggagacctgggccctgcgccaccccgggttcaccgtgatcgcgctgttcctcgcccacgccatcggcaccagcatcacgcagaaggggatcatcttcatcctgctgatgctcgtcaccccctccatggccatgcggtgcgtgggcatcggcaaccgcgacttcgtggaggggctgagcggcgcgacctgggtcgacgtggtgctggagcacgggtcctgcgtcaccacgatggccaaggacaagcccaccctcgacatcgagctgctgaagaccgaggtgaccaaccccgccgtgctccggaagctgtgcatcgaggccaagatcagcaacacgaccaccgactcccgctgcccgacccagggcgaggccacgctggtcgaggagcaggacgcgaacttcgtgtgccggcgcaccttcgtggaccggggctgggggaacggctgcggcctcttcggcaaggggagcctgatcacgtgcgccaagttcaagtgcgtcaccaagctggagggcaagatcgtgcagtacgagaacctcaagtactccgtgatcgtcacggtgcacaccggcgaccagcaccaggtcgggaacgagaccaccgagcacggcaccatcgccacgatcacgccccaggcccccaccagcgagatccagctgaccgactacggggccctgacgctcgactgcagcccccggaccggcctggacttcaacgagatggtgctgctcaccatgaaggagaagtcctggctggtgcacaagcagtggttcctggacctcccgctgccctggacctccggggcgagcacgagccaggagacctggaaccggcaggacctgctcgtcaccttcaagaccgcccacgccaagaagcaggaggccgtggtgctgggctcccaggagggcgccatgcacacggcgctgaccggggccaccgagatccagaccagcggcacgaccaccatcttcgccgggcacctcaagtgccgcctgaagatggacaagctgaccctcaagggcatctcctacgtcatgtgcacggggagcttcaagctggagaaggaggtggccgagacccagcacggcaccgtgctggtccaggtgaagtacgagggcaccgacgccccctgcaagatccccttctccagccaggacgagaagggggtgacgcagaacggccggctggtcaccgcgaacccgatcgtgaccgacaaggagaagcccgtgaacatcgaggccgagccgcccttcggggagtcctacatcgtcgtgggcgccggcgagaaggccctcaagctgagctggttcaagaaggggtccagcatcggcaagatgttcgaggcgaccgcccgcggggcccggcgcatggccatcctgggcgacacggcctgggacttcgggtccatcggcggcgtgttcaccagcgtcgggaagctcgtgcaccagatcttcggcaccgcgtacggggtgctgttctccggcgtcagctggaccatgaagatcgggatcggcatcctgctcacgtggctgggcctgaactcccgcagcacctccctcagcatgacctgcatcgccgtggggatggtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggccgacagcccgaagcgcctgtccgccgcgatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcagcggcatcctcgcccaggggaagaagacgatccggccccagcccatggagcacaagtactcctggaagtcctggggcaaggccaagatcatcggcgcggacgtgcagaacaccaccttcatcatcgacgggcccaacaccccggagtgccccgacgaccagcgcgcctggaacatctgggaggtggaggactacggcttcgggatcttcacgaccaacatctggctgaagctgcgggactcctacacccaggtctgcgaccaccgcctcatgagcgccgccatcaaggactccaaggcggtgcacgccgacatgggctactggatcgagagcgagaagaacgagacctggaagctggcccgggcctccttcatcgaggtgaagacgtgcgtctggcccaagagccacaccctgtggtccaacggcgtgctcgagagcgagatgatcatccccaagatctacgggggcccgatctcccagcacaactaccgccccgggtacttcacccagaccgccggcccctggcacctggggaagctggagctcgacttcgacctgtgcgagggcacgaccgtggtcgtggacgagcactgcggcaaccgggggccgagcctgcgcaccaccacggtgaccggcaagatcatccacgagtggtgctgccggtcctgcaccctgccgcccctgcgcttcaagggggaggacggctgctggtacgggatggagatccggcccgtcaaggagaaggaggagaacctggtcaagagcatggtgagcgcgggctccggcgaggtcgacagcttctccctcgggctgctgtgcatcagcatcatgatcgaggaggtgatgcgctcccggtggagccgcaagatgctcatgaccggcacgctggtggtcttcctgctcctgaccctggggcagctcacctggaacgacctgatccggctgtgcatcatggtgggcgccaacgcctccgacaacatggggatgggcaccacgtacctcgccctgatggccaccttccgcatgcgcccgatgttcgccgtcgggctcctcttccggcgcctgaccagccgggaggtgctgctcctgaccgtggggctgtccctcgtcgccagcgtggagctgcccaactccctggaggagctcggcgacgggctggccatgggcatcatgatcctgaagctcctgacggacttccagagccaccagctgtgggccaccctcctgtccctgaccttcgtgaagaccacgctcagcctgcactacgcctggaagaccatggcgatgatcctgtccatcgtcagcctcctgcccctgtgcctctccaccaccagccagaagacgacctggctgcccgtgctgctcggctccctggggtgcaagccgctgaccatgttcctcatcaccgagaacaagatctggggccgcaagagctggcccctgaacgaggggatcatggccgtgggcatcgtcagcatcctgctctccagcctgctgaagaacgacgtgcccctcgccgggcccctgatcgccggcggcatgctgatcgcgtgctacgtgatctccgggagctccgccgacctcagcctggagaaggccgccaaggtctcctgggaggaggaggccgagcacagcggcgcgtcccacaacatcctggtggagatccaggacgacgggaccatgaagatcaaggacgaggagcgggacgacacgatcaccatcctcctgaaggccaccctgctcgccatcagcggcgtgtacccgatgtccatccccgccaccctgttcgtctggtacttctggcagaagaagaagcagcgcagcggggtgctgtgggacacgcccagcccgcccgaggtggagaaggccgtcctggacgacggcatctaccggatcctccagcgcggcctgctggggcggagccaggtgggcgtgggggtcttccaggagggcgtgttccacaccatgtggcacgtgacccgcggggcggtcctcatgtaccagggcaagcggctggagccctcctgggccagcgtgaagaaggacctgatctcctacggcgggggctggcgcttccaggggagctggaacaccggcgaggaggtgcaggtcatcgccgtggagcccgggaagaaccccaagaacgtgcagacggcccccggcaccttcaagacctccgagggcgaggtcggggccatcgcgctcgacttcaagcccggcaccagcgggagccccatcgtgaaccgggagggcaagatcgtgggcctgtacgggaacggcgtcgtgacgacctccgggacctacgtgagcgccatcgcccaggccaaggcctcccaggagggccccctgccggagatcgaggacgaggtcttccgcaagcggaacctcaccatcatggacctgcaccccgggagcggcaagacgcgccggtacctgcccgcgatcgtgcgcgaggccatcaagcggaagctccgcaccctggtgctggccccgacccgggtcgtggcctccgagatggcggaggccctcaagggcatgcccatccgctaccagaccacggccgtcaagagcgagcacaccgggaaggagatcgtcgacctgatgtgccacgccaccttcaccatgcgcctgctctcccccgtgcgggtgcccaactacaacatgatcatcatggacgaggcccacttcacggacccggcgagcatcgccgcccgcggctacatctccacccgggtcgggatgggcgaggccgccgcgatcttcatgaccgccacgccgcccgggagcgtggaggccttcccccagtccaacgccgtgatccaggacgaggagaaggacatcccggagcgcagctggaactccggctacgactggatcacggacttccccggcaagaccgtctggttcgtgcccagcatcaagtccgggaacgacatcgccaactgcctgcggaagaacggcaagcgcgtgatccagctgagccggaagaccttcgacaccgagtaccagaagacgaagaacaacgactgggactacgtcgtgaccaccgacatctccgagatgggggcgaacttccgcgccgaccgggtcatcgacccccgccggtgcctcaagccggtgatcctgaaggacggccccgagcgcgtgatcctggccgggcccatgcccgtcaccgtggccagcgcggcccagcggcgcggccggatcggccgcaaccagaacaaggagggggaccagtacatctacatgggccagccgctcaacaacgacgaggaccacgcccactggacggaggccaagatgctgctggacaacatcaacacccccgaggggatcatccccgccctcttcgagcccgagcgggagaagtccgcggccatcgacggcgagtaccgcctgcgcggggaggcccgcaagaccttcgtggagctgatgcgccggggcgacctcccggtctggctgagctacaaggtggccagcgagggcttccagtactccgaccgccggtggtgcttcgacggggagcgcaacaaccaggtgctggaggagaacatggacgtcgagatctggaccaaggagggcgagcggaagaagctccgcccccggtggctggacgcccgcacgtacagcgaccccctggcgctccgggagttcaaggagttcgccgccgggcgccggtccgtgagcggcgacctgatcctggagatcggcaagctcccccagcacctgacccagcgcgcccagaacgccctggacaacctcgtgatgctgcacaactccgagcagggcgggaaggcgtaccggcacgccatggaggagctgccggacaccatcgagaccatcatgctcctggccctgatcgccgtcctcaccgggggcgtgacgctgttcttcctgagcgggcgcggcctcggcaagacctccatcgggctgctgtgcgtgatgagctccagcgcgctcctgtggatggcctccgtcgagccccactggatcgccgccagcatcatcctggagttcttcctcatggtgctgctgatccccgagcccgaccggcagcgcaccccgcaggacaaccagctcgcctacgtggtcatcggcctgctgttcatgatcctcaccgtggcggccaacgagatggggctgctggagacgaccaagaaggacctcggcatcgggcacgccgccgccgagaaccaccaccacgcggccatgctggacgtggacctgcaccccgcctccgcctggaccctctacgccgtcgcgaccacgatcatcacccccatgatgcggcacaccatcgagaacaccacggccaacatcagcctgaccgccatcgccaaccaggccgcgatcctgatgggcctcgacaagggctggccgatctccaagatggacatcggggtgcccctgctggccctcggctgctacagccaggtgaaccccctgaccctgaccgccgccgtcctcatgctggtggcgcactacgccatcatcgggcccggcctgcaggccaaggccacgcgcgaggcccagaagcggaccgcggccgggatcatgaagaacccgaccgtggacggcatcgtcgccatcgacctcgaccccgtggtgtacgacgccaagttcgagaagcagctgggccagatcatgctgctcatcctgtgcacctcccagatcctgctcatgcgcacgacctgggccctgtgcgagagcatcaccctggcgaccgggcccctcacgaccctgtgggagggctcccccgggaagttctggaacaccaccatcgccgtcagcatggccaacatcttccggggcagctacctggccggcgccgggctcgcgttctccctgatgaagtccctgggcgggggccgccgcgggacgggcgcccagggcgagaccctcggggagaagtggaagcggcagctgaaccagctgtccaagagcgagttcaacacctacaagcgctccggcatcatcgaggtggaccggagcgaggccaaggaggggctcaagcgcggcgagaccacgaagcacgccgtgtcccgggggaccgcgaagctgcgctggttcgtcgagcggaacctggtgaagccggagggcaaggtgatcgacctgggctgcgggcgcggcgggtggagctactactgcgccggcctcaagaaggtcaccgaggtgaaggggtacaccaagggcggccccgggcacgaggagcccatccccatggccacgtacggctggaacctggtgaagctgcactccgggaaggacgtcttcttcatcccgcccgagaagtgcgacaccctcctgtgcgacatcggcgagagctcccccaaccccaccatcgaggaggggcggaccctgcgcgtgctcaagatggtggagccgtggctgcggggcaaccagttctgcatcaagatcctgaacccctacatgcccagcgtcgtggagaccctcgagcagatgcagcgcaagcacggcgggatgctggtgcggaaccccctgtcccgcaacagcacgcacgagatgtactgggtctcctgcggcaccgggaacatcgtgagcgccgtgaacatgacctcccggatgctcctgaaccgcttcaccatggcccaccggaagccgacgtacgagcgcgacgtcgacctgggcgcgggcacccggcacgtggccgtggagcccgaggtcgccaacctcgacatcatcgggcagcgcatcgagaacatcaagaacgagcacaagagcacctggcactacgacgaggacaacccctacaagacctgggcctaccacggctcctacgaggtgaagcccagcgggagcgcctccagcatggtcaacggcgtggtgcgcctgctgacgaagccgtgggacgtcatccccatggtgacccagatcgcgatgaccgacaccacgcccttcgggcagcagcgggtgttcaaggagaaggtcgacacccgcacccccaaggccaagcggggcaccgcccagatcatggaggtgacggccaagtggctctggggcttcctgtcccgcaacaagaagccgcggatctgcacccgcgaggagttcacccggaaggtgcgcagcaacgccgcgatcggggccgtcttcgtggacgagaaccagtggaactccgccaaggaggccgtggaggacgagcggttctgggacctggtccgccgggagcgcgagctccacaagcagggcaagtgcgcgacctgcgtgtacaacatgatggggaagcgggagaagaagctgggcgagttcgggaaggccaagggcagccgcgccatctggtacatgtggctgggcgcccggttcctcgagttcgaggccctggggttcatgaacgaggaccactggttctcccgcgagaacagcctgtccggcgtggagggggagggcctccacaagctggggtacatcctgcgggacatcagcaagatccccggcggcaacatgtacgcggacgacacggccgggtgggacacccgcatcaccgaggacgacctccagaacgaggccaagatcaccgacatcatggagcccgagcacgccctgctggccacgtccatcttcaagctcacctaccagaacaaggtcgtgcgggtgcagcgcccggcgaagaacggcaccgtcatggacgtgatcagccggcgcgaccagcgcgggtccggccaggtgggcacctacgggctgaacacgttcaccaacatggaggcccagctgatccggcagatggagagcgagggcatcttctcccccagcgagctcgagacccccaacctggccgggcgcgtcctggactggctcgagaagcacggcaccgagcggctgcgccggatggccatctccggggacgactgcgtggtgaagcccatcgacgaccgcttcgccacggcgctgaccgccctcaacgacatgggcaagatccggaaggacatcccgcagtgggagcccagcaagggctggaacgactggcagcaggtccccttctgcagccaccacttccaccagctgatcatgaaggacgggcgcgagatcgtggtgccctgccggaaccaggacgagctggtcggccgcgcccgggtgtcccagggggccggctggagcctccgcgagaccgcctgcctggggaagtcctacgcgcagatgtggcagctgatgtacttccaccggcgcgacctccggctggccgccaacgccatctgcagcgcggtgccggtcgactgggtgcccacctcccgcacgacctggagcatccacgcccaccaccagtggatgaccaccgaggacatgctgtccgtgtggaaccgggtctggatcgaggagaacccctggatggaggacaagacccacgtgagctcctgggaggacgtgccctacctcggcaagcgcgaggaccagtggtgcggcagcctgatcgggctgacggcccgggccacctgggccaccaacatccaggtcgcgatcaaccaggtgcgccgcctcatcggcaacgagaactacctggactacatgacctccatgaagcggttcaagaacgagagcgacccggagggggccctgtggtga

SEQ ID NO: 7914 - RNA, 9879 nt, synthetic construct
  misc_feature 1..9879: note = derived and/or modified CDS sequence (opt1) from DENV-1__AB189121__SS-prME
  source 1..9879: mol_type = other RNA
agcgtgaccatgctgttcatgctcctgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgagaccgagcccgacgacgtggactgctggtgcaacgccaccgagacctgggtgacctacgggacctgcagccagaccggcgagcaccggcgcgacaagcggtccgtggccctcgcgccccacgtgggcctggggctggagacccgcaccgagacctggatgagctccgagggcgcctggcggcagatccagaaggtggagacctgggccctccgccaccccgggttcaccgtgatggccctgttcctggcccacgcgatcggcaccagcatcacccagaaggggatcatcttcatcctcctgatgctggtgacgccctccatggccatgcggtgcgtgggcatcggcaaccgcgacttcgtggaggggctcagcggcgccacctgggtggacgtggtgctggagcacgggtcctgcgtgaccaccatggccaaggacaagcccacgctggacatcgagctcctgaagaccgaggtcaccaaccccgccgtgctgcggaagctctgcatcgaggcgaagatcagcaacaccacgaccgactcccgctgcccgacccagggcgaggccaccctggtggaggagcaggacacgaacttcgtctgccggcgcaccttcgtggaccggggctgggggaacggctgcgggctgttcggcaaggggagcctcatcacgtgcgccaagttcaagtgcgtgaccaagctggagggcaagatcgtccagtacgagaacctgaagtactccgtgatcgtgacggtccacaccggcgaccagcaccaggtggggaacgagaccaccgagcacggcaccacggccatcatcacgccccaggcccccaccagcgagatccagctcaccgactacggggcgctgacgctggactgcagcccccgcaccggcctcgacttcaacgagatggtcctgctgaccatgaaggagaagtcctggctcgtgcacaagcagtggttcctggacctgccgctcccctggacctccggggccagcacgagccaggagacctggaaccggcaggacctgctggtgaccttcaagaccgcccacgccaagaagcaggaggtcgtggtgctcggctcccaggagggcgccatgcacacggcgctgaccggggccaccgagatccagaccagcggcacgaccaccatcttcgccgggcacctgaagtgccgcctcaagatggacaagctgaccctgaagggcgtctcctacgtgatgtgcacggggagcttcaagctcgagaaggaggtggccgagacccagcacggcaccgtcctggtccaggtgaagtacgagggcaccgacgccccctgcaagatccccttctccagccaggacgagaagggggtcatccagaacggccggctgatcacggcgaacccgatcgtgaccgacaaggagaagcccgtgaacatcgaggccgagccgcccttcggggagtcctacatcgtcgtgggcgccggcgagaaggccctgaagctcagctggttcaagaaggggtccagcatcggcaagatgttcgaggcgaccgcccgcggggcccggcgcatggccatcctgggcgacaccgcctgggacttcgggtccatcggcggcgtgttcacgagcgtcgggaagctggtgcaccagatcttcggcaccgcgtacggggtcctcttctccggcgtcagctggaccatgaagatcgggatcggcatcctgctgacctggctcggcctgaactcccgcagcacgtccctgagcatgacctgcatcgccgtggggatggtgaccctctacctgggcgtcatggtgcaggccgactccgggtgcgtgatcaactggaagggccgggagctgaagtgcgggagcggcatcttcgtcaccaacgaggtgcacacgtggaccgagcagtacaagttccaggccgacagcccgaagcgcctctccgccgcgatcggcaaggcctgggaggagggggtgtgcggcatccggagcgccacccgcctggagaacatcatgtggaagcagatctccaacgagctgaaccacatcctcctggagaacgacatgaagttcaccgtcgtggtgggggacgtcagcggcatcctggcccaggggaagaagatgatccggccccagcccatggagcacaagtactcctggaagtcctggggcaaggccaagatcatcggcgcggacgtgcagaacatcaccttcatcatcgacgggcccaacacgtccgagtgcccggacaaccagcgcgcctggaacatctgggaggtggaggactacggcttcgggatcttcaccaccaacatctggctcaagctgcgggacagctacacccaggtctgcgaccaccgcctgatgtccgccgccatcaaggacagcaaggcggtgcacgccgacatgggctactggatcgagtccgagaagaacgagacgtggaagctcgcccgggccagcttcatcgaggtgaagacctgcatctggcccaagtcccacaccctgtggagcaacggcgtcctggagtccgagatgatcatccccaagatctacgggggccccgtgagccagcacaactaccgcccggggtacttcacccagacggccggcccctggcacctcgggaagctggagctggacttcgacctctgcgagggcaccaccgtggtcgtggacgagaactgcggcaaccgggggccctccctgcgcaccacgaccgtgaccggcaagaccatccacgagtggtgctgccggagctgcacgctgccgcccctccgcttcaagggggaggacggctgctggtacgggatggagatccggcccgtcaaggagaaggaggagaacctggtcaagagcatggtgtccgcgggcagcggcgaggtcgactccttcagcctggggctcctgtgcatctccatcatgatcgaggaggtgatgcgcagccggtggtcccgcaagatgctgatgaccggcaccctcgccgtgttcctgctgctcaccatggggcagctgacgtggaacgacctgatccggctctgcatcatggtcggcgccaacgccagcgacatgatggggatgggcaccacctacctggccctgatggcgaccttccgcatgcgccccatgttcgccgtgggcctcctgttccggcgcctgacgtcccgggaggtcctcctgctgaccgtggggctcagcctggtggcctccgtcgagctgccgaacagcctcgaggagctgggcgacgggctggccatgggcatcatgatgctcaagctgctgaccgacttccagccccaccagctctgggccaccctgctgtccctcacgttcgtgaagaccaccttcagcctgcactacgcgtggaagaccatggccatgatcctgtccatcgtgagcctcctgcccctgtgcctctccacgaccagccagaagaccacctggctgcccgtcctgctcggctccctggggtgcaagccgctgacgatgctcctgatcaccgagaacaagatctggggccgccggagctggcccctgaacgaggggatcatggccatcggcatcgtgagcatcctcctgtccagcctgctcaagaacgacgtgcccctggccgggcccctgatcgcgggcggcatgctcatcgcctgctacgtcatctccgggagctccgccgacctgagcctggagaaggccgccgaggtgtcctgggaggacgaggcggagcacagcggcgcctcccacaacatcctcgtggaggtccaggacgacgggaccatgaagatcaaggacgaggagcgcgacgacaccctgaccatcctgctcaaggccacgctgctggccatcagcggcgtgtacccgatgtccatccccgccaccctcttcgtgtggtacttctggcagaagaagaagcagcggagcggggtcctgtgggacacccccagcccgcccgaggtggagcgcgcggtgctggacaacggcatctaccggatcctgcagcgcggcctcctggggcggagccaggtcggcgtgggggtgttccaggagggcgtcttccacaccatgtggcacgtgacgcgcggggccgtgctgatgtaccagggcaagcggctcgagccctcctgggccagcgtcaagcgcgacctgatctcctacggcgggggctggcggttccaggggagctggaacaccggcgaggaggtccaggtgatcgccgtcgagcccgggaagaaccccaagaacgtgcagaccacccccggcacgttcaagacccccgagggcgaggtgggggccatcgcgctggacttcaagcccggcacctccgggagccccatcgtcaaccgcgagggcaagatcgtgggcctctacgggaacggcgtggtcaccacgagcgggacctacgtgtccgccatcgcccaggccaaggccagccaggagggcccgctgcccgagatcgaggacgaggtgttccggaagcgcaacctgaccatcatggacctccaccccgggtccggcaagacccggcgctacctgccggcgatcgtccgggaggccatcaagcgcaagctgcgcacgctcgtgctggcccccacccgggtggtcgccagcgagatggcggaggccctgaagggcatgcccatccgctaccagaccaccgccgtgaagtccgagcacacggggaaggagatcgtggacctcatgtgccacgccaccttcaccatgcggctgctgagccccgtccgcgtgccgaactacaacatgatcatcatggacgaggcccacttcaccgaccccgcgtccatcgccgcccggggctacatcagcacgcgcgtggggatgggcgaggccgccgcgatcttcatgaccgccacgccgcccgggtccgtcgaggccttcccgcagagcaacgccgtgatccaggacgaggagcgggacatccccgagcgctcctggaacagcggctacgagtggatcaccgacttccccggcaagacggtgtggttcgtcccctccatcaagagcgggaacgacatcgccaactgcctccggaagaacggcaagcgcgtggtgcagctgtcccggaagaccttcgacaccgagtaccagaagaccaagaacaacgactgggactacgtcgtgacgaccgacatcagcgagatgggggcgaacttccgcgccgaccgggtcatcgacccgcgccggtgcctgaagcccgtgatcctcaaggacggccccgagcgcgtgatcctggccgggcccatgccggtcaccgtggcctccgcggcccagcggcgcggccggatcggccgcaaccccaacaaggagggggaccagtacgtgtacatgggccagcccctgaacaacgacgaggaccacgcccactggaccgaggccaagatgctcctggacaacatcaacacgcccgaggggatcatcccggccctgttcgagcccgagcgcgagaagtccgcggccatcgacggcgagtaccggctccgcggggaggcccggaagaccttcgtcgagctgatgcgccggggcgacctgcccgtgtggctctcctacaaggtggccagcgagggcttccagtacagcgaccgccggtggtgcttcgacggggagcgcaacaaccaggtcctggaggagaacatggacgtggagatctggaccaaggagggcgagcggaagaagctgcgcccccggtggctcgacgcccgcacctactccgacccgctggcgctgcgggagttcaaggagttcgccgccgggcgccggagcgtgtccggcgacctcatcctggagatcggcaagctgccccagcacctcacgcagaaggcccagaacgccctggacaacctggtcatgctccacaacagcgagcagggcgggaaggcgtaccgccacgccatggaggagctgcccgacaccatcgagaccctgatgctcctggccctgatcgccgtgctcaccgggggcgtgaccctgttcttcctgtccgggcggggcctcggcaagacgagcatcgggctgctgtgcgtcatggcgtccagcgccctcctgtggatggcctccgtggagccccactggatcgccgccagcatcatcctggagttcttcctcatggtgctgctgatcccggagcccgaccgccagcggacgccccaggacaaccagctcgcgtacgtcgtgatcggcctgctgttcatgatcctcaccgtggccgccaacgagatggggctgctggagaccacgaagaaggacctcggcatcgggcacgccgccgcggagaaccaccaccacgccgccatgctggacgtcgacctgcacccggcctccgcctggaccctctacgcggtggccaccaccatcatcacgcccatgatgcgccacaccatcgagaacaccaccgccaacatcagcctgacggccatcgccaaccaggcggccatcctgatgggcctcgacaagggctggcccatctccaagatggacatcggggtgcccctgctggccctcggctgctacagccaggtcaacccgctgaccctgaccgccgcggtgctcatgctggtggcccactacgccatcatcgggcccggcctgcaggccaaggccacccgggaggcgcagaagcgcacggccgccgggatcatgaagaaccccaccgtcgacggcatcgtggccatcgacctcgaccccgtggtctacgacgccaagttcgagaagcagctgggccagatcatgctgctcatcctgtgcacctcccagatcctgctcatgcgcaccacgtgggcgctgtgcgagagcatcaccctggccaccgggccgctcaccacgctgtgggagggctcccccgggaagttctggaacaccaccatcgccgtgagcatggccaacatcttccggggctcctacctggccggcgcggggctcgccttcagcctgatgaagtccctgggcgggggccgccgggggaccggcgcccagggcgagacgctcggggagaagtggaagcgccagctgaaccagctgtccaagagcgagttcaacatctacaagcggtccggcatcatcgaggtggaccgcagcgaggccaaggaggggctcaagcggggcgagaccaccaagcacgcggtctcccgcgggaccgccaagctgcggtggttcgtggagcgcaacctggtgaagcccgagggcaaggtcatcgacctgggctgcgggcggggcgggtggagctactactgcgccggcctcaagaaggtgacggaggtgaaggggtacaccaagggcggccccgggcacgaggagccgatccccatggccacctacggctggaacctggtcaagctgcactccgggaaggacgtgttcttcacgccgcccgagaagtgcgacacgctcctgtgcgacatcggcgagagctccccgaaccccaccatcgaggaggggcgcaccctgcgggtgctcaagatggtcgagccctggctgcgcggcaaccagttctgcatcaagatcctgaacccctacatgccgagcgtggtggagaccctcgagaagatgcagcggaagcacggcgggatgctggtccgcaaccccctgtcccggaacagcacccacgagatgtactgggtgtcctgcggcacggggaacatcgtgagcgccgtcaacatgacctcccgcatgctcctgaaccggttcaccatggcgcaccgcaagcccacctacgagcgcgacgtggacctgggcgccggcacgcggcacgtggccgtcgagcccgaggtggccaacctcgacatcatcgggcagcgcatcgagaacatcaagaacgagcacaagagcacctggcactacgacgaggacaacccgtacaagacctgggcctaccacggctcctacgaggtcaagcccagcgggtccgcgagcagcatggtgaacggcgtggtccggctgctgaccaagccctgggacgtgatccccatggtgacgcagatcgccatgaccgacaccaccccgttcgggcagcagcgcgtcttcaaggagaaggtggacacgcggacccccaaggccaagcgcggcaccgcccagatcatggaggtgaccgcccggtggctctggggcttcctgtcccgcaacaagaagccccggatctgcacgcgcgaggagttcacccggaaggtccgcagcaacgcggccatcggggccgtgttcgtggacgagaaccagtggaactccgccaaggaggcggtcgaggacgagcggttctgggacctggtgcaccgcgagcgggagctccacaagcagggcaagtgcgcgacctgcgtgtacaacatgatggggaagcgcgagaagaagctgggcgagttcgggaaggccaagggcagccgggccatctggtacatgtggctgggcgcccgcttcctcgagttcgaggcgctggggttcatgaacgaggaccactggttctcccgggagaacagcctgtccggcgtcgagggggagggcctccacaagctggggtacatcctgcgcgacatcagcaagatcccgggcggcaacatgtacgccgacgacaccgccgggtgggacacgcggatcaccgaggacgacctccagaacgaggccaagatcaccgacatcatggagcccgagcacgccctgctggcgacctccatcttcaagctcacgtaccagaacaaggtggtgcgcgtccagcgccccgccaagaacggcaccgtgatggacgtgatcagccggcgcgaccagcgggggtccggccaggtcggcacctacgggctgaacaccttcacgaacatggaggcccagctgatccgccagatggagagcgagggcatcttctcccccagcgagctcgagaccccgaacctggccgagcgggtgttcgactggctggagaagcacgggatcgagcgcctcaagcggatggccatctccggcgacgactgcgtggtcaagcccatcgacgaccgcttcgcgaccgccctgaccgccctgaacgacatggggaaggtgcggaaggacatcccccagtgggagcccagcaagggctggaacgactggcagcaggtcccgttctgctcccaccacttccaccagctcatcatgaaggacggccgcgagatcgtcgtgccctgccggaaccaggacgagctggtggggcgcgcccgggtcagccagggcgccgggtggagcctgcgcgagacggcgtgcctcggcaagtcctacgcccagatgtggcagctgatgtacttccaccggcgcgacctgcggctcgccgccaacgcgatctgcagcgccgtgcccgtggactgggtccccacctcccgcaccacctggagcatccacgcccaccaccagtggatgacgaccgaggacatgctgtccgtgtggaaccgggtgtggatcgaggagaacccgtggatggaggacaagacccacgtcagctcctgggaggacgtgccctacctggggaagcgcgaggaccagtggtgcggcagcctcatcggcctgaccgcccgcgccacctgggcgacgaacatccaggtggccatcaaccaggtccggcgcctgatcgggaacgagaactacctcgactacatgacctccatgaagcggttcaagaacgagagcgaccccgagggcgccctgtggtga

SEQ ID NO: 7915 - RNA, 9879 nt, synthetic construct
  misc_feature 1..9879: note = derived and/or modified CDS sequence (opt1) from DENV-1__AB195673__SS-prME
  source 1..9879: mol_type = other RNA
agcgtgaccatgctgctcatgctgctgcccaccgccctcaccttccacctgaccacccgcggcggggagccccacatgatcgtgggcaagcaggagcggggcaagagcctgctgttcaagaccagcgccggggtgaacatgtgcaccctgatcgccatggacctgggggagctctgcgacgacaccatgacctacaagtgcccccgcatcaccgagacggagcccgacgacgtggactgctggtgcaacgccaccgagacctgggtcacctacggcacgtgcagccagaccggcgagcaccggcgcgacaagcggagcgtggccctggcgccccacgtggggctgggcctcgagacccgcaccgagacgtggatgtccagcgagggggcctggcggcagatccagaaggtcgagacctgggccctgcgccaccccggcttcaccgtgatcgccctgttcctcgcccacgtgatcgggacctccatcacgcagaagggcatcatcttcatcctgctgatgctcgtcacccccagcatggccatgcggtgcgtgggcatcgggaaccgcgacttcgtggagggcctgtccggggcgacctgggtcgacgtggtgctggagcacggcagctgcgtcaccacgatggccaaggacaagcccaccctcgacatcgagctgctgaagaccgaggtgaccaaccccgccgtgctccggaagctgtgcatcgaggccaagatctccaacacgaccaccgacagccgctgcccgacccagggcgaggccacgctggtcgaggagcaggacaccaacttcgtgtgccggcgcaccttcgtggaccgggggtggggcaacgggtgcggcctcttcgggaagggctccctgatcacgtgcgcgaagttcaagtgcgtcacgaagctggagggcaagatcgtgcagtacgagaacctcaagtacagcgtgatcgtcaccgtgcacaccggggaccagcaccaggtcggcaacgagaccaccgagcacgggacgatcgccaccatcacgccccaggcccccacctccgagatccagctgacggactacggcgccctgaccctcgactgcagcccccgcaccgggctggacttcaacgagatggtgctgctcaccatgaaggagaagtcctggctggtgcacaagcagtggttcctggacctcccgctgccctggacgagcggcgcctccaccagccaggagacctggaaccggcaggacctgctcgtcaccttcaagacggcgcacgccaagaagcaggaggtggtggtcctgggcagccaggagggggccatgcacaccgccctgaccggcgccaccgagatccagacgtccgggaccaccaccatcttcgcgggccacctcaagtgccgcctgaagatggacaagctgacgctcaaggggatcagctacgtgatgtgcaccggctccttcaagctggagaaggaggtggccgagacccagcacggcaccgtcctggtccaggtgaagtacgaggggacggacgccccctgcaagatccccttcagctcccaggacgagaagggcgtcacccagaacgggcggctggtgaccgccaacccgatcgtgaccgacaaggagaagcccgtcaacatcgaggccgagccgcccttcggcgagagctacatcgtggtgggcgcgggggagaaggccctcaagctgtcctggttcaagaagggcagctccatcgggaagatgttcgaggccacggcccgcggcgcgcggcgcatggccatcctgggggacaccgcctgggacttcggcagcatcggcggggtcttcacctccgtgggcaagctcgtgcaccagatcttcgggaccgcctacggcgtcctgttcagcggggtgtcctggacgatgaagatcggcatcggcatcctgctcacctggctggggctgaacagccgctccaccagcctctccatgacctgcatcgccgtgggcctgatcacgctgtacctcggggtcatggtgcaggcggacagcggctgcgtgatcaactggaaggggcgggagctgaagtgcggctccggcatcttcgtcaccaacgaggtgcacacctggaccgagcagtacaagttccaggccgacagcccgaagcgcctgagcgccgccatcgggaaggcctgggaggagggcgtgtgcgggatccggtccgcgacccgcctcgagaacatcatgtggaagcagatcagcaacgagctgaaccacatcctgctcgagaacgacatgaagttcacggtcgtggtgggcgacgtctccgggatcctggcccagggcaagaagtccatccggccccagcccatggagcacaagtactcctggaagtcctggggcaaggccaagatcatcggggccgacgtgcagaacaccaccttcatcatcgacggccccaacaccccggagtgccccgacgaccagcgcgcctggaacatctgggaggtggaggactacgggttcggcatcttcacgaccaacatctggctgaagctccgggactcctacacccaggtctgcgaccaccgcctgatgagcgcggccatcaaggactccaaggccgtgcacgccgacatgggctactggatcgagagcgagaagaacgagacctggaagctggcgcgggcctccttcatcgaggtgaagacgtgcatctggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttcaagggcgaggacgggtgctggtacggcatggagatccggcccgtgaaggagaaggaggagaacctcgtcaagagcatggtgagcgccggctccggggaggtggacagcttctccctgggcctgctctgcatcagcatcatgatcgaggaggtcatgcgctcccggtggagccgcaagatgctgatgaccgggacgctggccgtgttcctcctgctgaccatgggccagctcacctggaacgacctgatccggctgtgcatcatggtgggggcgaacgcctccgacaacatgggcatgggcaccacgtacctcgccctgatggccaccttccgcatgcgcccgatgttcgccgtcgggctcctgttccggcgcctgaccagccgggaggtgctgctcctgaccgtcggcctgtccctcgtggcgagcgtggagctgcccaactccctggaggagctcggggacggcctggccatgggcatcatgatcctgaagctcctgacggacttccagagccaccagctgtgggccaccctcctgtccctgaccttcgtcaagaccacgttcagcctccactacgcctggaagaccatggccatgatcctgtccatcgtgagcctgttccccctctgcctgtccaccaccagccagaagacgacctggctgcccgtgctcctggggtccctgggctgcaagccgctcaccatgttcctgatcaccgagaacaagatctgggggcgcaagagctggcccctgaacgagggcatcatggcggtcgggatcgtgagcatcctcctgtccagcctgctcaagaacgacgtgcccctggccggccccctgatcgccggcgggatgctcatcgcctgctacgtcatctccggcagctccgcggacctgagcctggagaaggccgccgaggtgtcctgggaggaggaggccgagcacagcggggcctcccacaacatcctcgtggagatccaggacgacggcaccatgaagatcaaggacgaggagcgggacgacacgatcaccatcctgctgaaggcgaccctcctggccatcagcggggtctacccgatgtccatccccgccaccctgttcgtgtggtacttctggcagaagaagaagcagcgcagcggcgtgctctgggacacgcccagcccgcccgaggtcgagcgggccgtgctggacgacggcatctaccgcatcctgcagcgggggctgctcggccgcagccaggtgggggtcggcgtgttccaggagggggtgttccacaccatgtggcacgtcacccggggcgccgtgctgatgtaccagggcaagcgcctggagccctcctgggcgagcgtgaagaaggacctcatctcctacgggggcgggtggcggttccagggcagctggaacaccggggaggaggtccaggtgatcgccgtggagcccggcaagaaccccaagaacgtccagacggcccccggcaccttcaagacctccgagggggaggtgggcgccatcgccctggacttcaagcccgggaccagcggcagccccatcgtgaaccgcgagggcaagatcgtcgggctgtacggcaacggggtggtgacgacctccggcacctacgtcagcgcgatcgcccaggccaaggcctcccaggaggggcccctcccggagatcgaggacgaggtgttccggaagcgcaacctgaccatcatggacctgcaccccggcagcggcaagacgcggcgctacctccccgccatcgtgcgggaggcgatcaagcgcaagctgcggaccctggtcctcgccccgacccgcgtggtggcctccgagatggccgaggcgctgaaggggatgcccatccgctaccagaccacggccgtcaagagcgagcacaccggccgggagatcgtggacctgatgtgccacgccaccttcaccatgcgcctcctgtcccccgtgcgggtccccaactacaacatgatcatcatggacgaggcccacttcacggacccggccagcatcgcggcccgcgggtacatctccacccgggtgggcatgggggaggccgccgccatcttcatgaccgcgacgccgcccggcagcgtggaggccttcccccagtccaacgccgtcatccaggacgaggagaaggacatcccggagcgcagctggaactccggctacgactggatcacggacttccccgggaagaccgtgtggttcgtgcccagcatcaagtccggcaacgacatcgccaactgcctgcggaagaacgggaagcgcgtcatccagctcagccggaagaccttcgacaccgagtaccagaagacgaagaacaacgactgggactacgtggtgaccaccgacatctccgagatgggcgccaacttccgcgcggaccgggtcatcgacccccgccggtgcctgaagccggtgatcctgaaggacgggcccgagcgcgtcatcctcgccggccccatgcccgtgaccgtggccagcgccgcgcagcggcgcggccggatcgggcgcaaccagaacaaggagggcgaccagtacatctacatggggcagccgctgaacaacgacgaggaccacgcccactggacggaggccaagatgctgctcgacaacatcaacacccccgagggcatcatccccgccctgttcgagcccgagcgggagaagtccgccgcgatcgacggggagtaccgcctgcgcggcgaggcccggaagaccttcgtcgagctcatgcgccggggcgacctgccggtgtggctgagctacaaggtggccagcgaggggttccagtactccgaccgccggtggtgcttcgacggcgagcgcaacaaccaggtcctcgaggagaacatggacgtggagatctggaccaaggagggggagcggaagaagctgcgcccccggtggctggacgcccgcacgtacagcgaccccctcgccctgcgggagttcaaggagttcgcggccggccgccggtccgtgagcggcgacctgatcctcgagatcgggaagctgccccagcacctgacccagcgcgcccagaacgccctcgacaacctggtcatgctgcacaactccgagcagggcgggaaggcctaccggcacgcgatggaggagctcccggacaccatcgagaccctgatgctgctcgccctgatcgccgtgctgaccggcggggtgaccctcttcttcctgagcggccgcggcctggggaagacctccatcggcctcctgtgcgtcatgagctccagcgccctgctctggatggcgtccgtggagccccactggatcgccgccagcatcatcctggagttcttcctgatggtgctcctgatccccgagcccgaccggcagcgcaccccgcaggacaaccagctggcctacgtcgtgatcgggctcctgttcatgatcctgaccgtggccgcgaacgagatgggcctcctggagacgaccaagaaggacctggggatcggccacgccgccgccgagaaccaccaccacgccgcgatgctcgacgtcgacctgcaccccgcctccgcctggaccctgtacgccgtggccaccacgatcatcacccccatgatgcggcacaccatcgagaacaccacggcgaacatcagcctcaccgccatcgccaaccaggccgccatcctgatgggcctggacaaggggtggccgatctccaagatggacatcggcgtgcccctcctggcgctggggtgctacagccaggtcaaccccctcaccctgaccgccgccgtgctgatgctcgtggcccactacgcgatcatcggccccgggctgcaggccaaggccacgcgcgaggcccagaagcggaccgccgcgggcatcatgaagaacccgaccgtcgacggcatcgtggccatcgacctggaccccgtggtctacgacgccaagttcgagaagcagctcgggcagatcatgctgctgatcctctgcacctcccagatcctgctgatgcgcacgacctgggccctctgcgagagcatcaccctggccaccggccccctgacgaccctctgggaggggtcccccggcaagttctggaacaccaccatcgcggtgagcatggccaacatcttccgcggcagctacctggccggggccggcctggccttctccctcatgaagtccctcgggggcgggcggcgcggcacgggcgcgcagggggagaccctgggcgagaagtggaagcggcagctcaaccagctgtccaagagcgagttcaacatctacaagcgctccgggatcgtggaggtcgaccggagcgaggccaaggagggcctgaagcgcggggagaccatcaagcacgccgtgtcccggggcaccgccaagctccgctggttcgtggagcggaacctggtcaagccggagggcaaggtgatcgacctggggtgcggccgcgggggctggagctactactgcgcggggctgaagaaggtgacggaggtcaagggctacaccaagggcgggcccggccacgaggagcccatccccatggccacctacgggtggaacctcgtgaagctgtactccggcaaggacgtgttcttcatcccgcccgagaagtgcgacaccctgctctgcgacatcggggagagctcccccaaccccacgatcgaggagggccggaccctgcgcgtcctgaagatggtggagccgtggctccggggcaaccagttctgcatcaagatcctgaacccctacatgcccagcgtggtcgagaccctggagcagatgcagcgcaagcacgggggcatgctcgtgcggaaccccctgtcccgcaacagcacccacgagatgtactgggtgtcctgcgggaccggcaacatcgtcagcgccgtgaacatgacgtcccggatgctgctcaaccgcttcaccatggcccaccggaagccgacctacgagcgcgacgtggacctgggcgccgggacccgccacgtcgcggtggagcccgaggtggccaacctggacatcatcggccagcggatcgagaacatcaagaacgagcacaagagcacgtggcactacgacgaggacaacccctacaagacctgggcctaccacgggtcctacgaggtcaagcccagcggcagcgcctccagcatggtgaacggggtcgtgcgcctcctgaccaagccgtgggacgtgatccccatggtcacccagatcgccatgacggacaccacccccttcggccagcagcgggtgttcaaggagaaggtggacacccgcacgcccaaggcgaagcggggcaccgcccagatcatggaggtcaccgccaagtggctgtgggggttcctctcccgcaacaagaagccgcggatctgcacccgcgaggagttcacgcggaaggtgcgcagcaacgccgccatcggcgcggtgttcgtcgacgagaaccagtggaactccgccaaggaggccgtggaggacgagcggttctgggacctggtgcgccgggagcgcgagctgcacaagcaggggaagtgcgcgacctgcgtctacaacatgatgggcaagcgggagaagaagctcggggagttcggcaaggcgaagggcagccgcgccatctggtacatgtggctgggggcccggttcctggagttcgaggccctcggcttcatgaacgaggaccactggttctcccgcgagaacagcctgtccggggtggagggcgaggggctgcacaagctcggctacatcctgcgggacatcagcaagatccccggcgggaacatgtacgccgacgacaccgcgggctgggacacccgcatcacggaggacgacctgcagaacgaggccaagatcaccgacatcatggagcccgagcacgccctcctggccacctccatcttcaagctgacctaccagaacaaggtggtccgggtgcagcgcccggccaagaacgggacggtgatggacgtcatcagccgccgggaccagcgcggctccggccaggtggggacctacggcctcaacaccttcaccaacatgggggcgcagctgatccggcagatggagagcgagggcatcttctcccccagcgagctggagacgcccaacctcgccgggcgcgtgctggactggctggagaagcacggcatcgagcggctccgccggatggccatctccggcgacgactgcgtcgtgaagcccatcgacgaccgcttcgccaccgccctgaccgcgctgaacgacatggggaaggtgcggaaggacatcccgcagtgggagcccagcaagggctggaacgactggcagcaggtccccttctgcagccaccacttccaccagctcatcatgaaggacgggcgcgagatcgtggtgccctgccggaaccaggacgagctggtcggccgcgcccgggtgtcccagggggccggctggagcctgcgcgagaccgcctgcctcggcaagtcctacgcccagatgtggcagctgatgtacttccaccggcgcgacctgcggctcgcggccaacgccatctgcagcgccgtgccggtcgactgggtgcccacgtcccgcaccacctggagcatccacgcgcaccaccagtggatgaccacggaggacatgctgtccgtgtggaaccgggtctggatcgaggagaacccctggatggaggacaagacccacgtgagctcctgggaggacgtgccctacctggggaagcgcgaggaccagtggtgcggcagcctcatcgggctgaccgcccgcgccacctgggccaccaacatccaggtcgccatcaaccaggtgcggcgcctgatcggcaacgagaactacctcgactacatgacgtccatgaagcggttcaagaacgagagcgacccggagggggcgctgtggtga

SEQ ID NO: 7916 - RNA, 9879 nt, synthetic construct
  misc_feature 1..9879: note = derived and/or modified CDS sequence (opt1) from DENV-1__AB204803__SS-prME
  source 1..9879: mol_type = other RNA
agcgtgaccatgctgctcatgctgctgcccaccgtgctcaccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacaccatgacctacaagtgcccccgcatcaccgagaccgagcccgacgacgtggactgctggtgcaacgccaccgagacctgggtgacctacgggacgtgcagccagaccggcgagcaccggcgcgacaagcggtccgtggccctggcgccccacgtcggcctggggctcgagacccgcaccgagacgtggatgagctccgagggcgcctggaagcagatccagaaggtggagacctgggccctgcggcacccggggttcaccgtgatcgcgctgttcctcgcccacgccatcggcaccagcatcacgcagaaggggatcatcttcatcctgctgatgctcgtcaccccctccatggccatgcgctgcgtgggcatcggcaaccgggacttcgtggaggggctgagcggcgcgacctgggtcgacgtggtgctggagcacgggtcctgcgtcaccacgatggccaaggacaagcccaccctcgacatcgagctgctgaagaccgaggtgaccaaccccgccgtgctccgcaagctgtgcatcgaggccaagatcagcaacacgaccaccgactcccggtgcccgacccagggcgaggccacgctggtcgaggagcaggacaccaacttcgtgtgccgccggaccttcgtggaccgcggctgggggaacggctgcggcctcttcggcaaggggagcctgatcacgtgcgtcaagttcaagtgcgtgacgaagctggagggcaagatcgtgcagtacgagaacctcaagtactccgtcatcgtgaccgtccacaccggcgaccagcaccaggtggggaacgagaccaccgagcacggcacgatcgcgaccatcacgccccaggcccccaccagcgagatccagctgacggactacggggccctgaccctcgactgcagcccccggaccggcctggacttcaacgagatggtgctgctcaccatgaaggagaagtcctggctggtccacaagcagtggttcctggacctcccgctgccctggacgtccggggccagcaccagccaggagacctggaaccgccaggacctgctcgtgaccttcaagacggcccacgcgaagaagcaggaggtggtcgtgctgggctcccaggagggcgccatgcacaccgccctgaccggggccaccgagatccagacgagcggcaccaccaccatcttcgccgggcacctcaagtgccggctgaagatggacaagctgacgctcaagggcacctcctacgtgatgtgcaccgggcccttcaagctggagaaggaggtcgcggagacccagcacggcacggtgctggtgcaggtcaagtacgagggcaccgacgccccctgcaagatcccgttcagctcccaggacgagaagggggtgacccagaacggccgcctgatcaccgccaaccccatcgtgacggacaaggagaagcccatcaacatcgaggccgagcccccgttcggggagagctacatcgtcgtgggcgtgggcgagaaggccctcaagctgtcctggttcaagaaggggagctccatcggcaagatgttcgaggcgaccgcccgcggggcccgccggatggccatcctgggcgacaccgcgtgggacttcgggagcatcggcggcgtcttcacctccatggggaagctcgtgcaccagatcttcggcacggcctacggggtgctgttcagcggcgtctcctggaccatgaagatcgggatcggcatcctgctcacctggctgggcctgaacagccgctccaccagcctctccatgacgtgcatcgccgtggggatggtgaccctgtacctgggcgtcatggtgcaggccgacagcgggtgcgtgatcaactggaagggccgcgagctcaagtgcgggtccggcatcttcgtcaccaacgaggtgcacacctggaccgagcagtacaagttccaggccgacagccccaagcggctgagcgcggccatcggcaaggcctgggaggagggggtgtgcggcatccgctccgccacgcggctggagaacatcatgtggaagcagatcagcaacgagctcaaccacatcctgctggagaacgacatgaagttcaccgtcgtggtgggggacgtctccggcatcctcgcccaggggaagaagatgatccgcccccagcccatggagcacaagtacagctggaagtcctggggcaaggcgaagatcatcggcgccgacgtgcagaacaccaccttcatcatcgacgggccgaacacgcccgagtgcagcgacgaccagcgggcctggaacatctgggaggtggaggactacggcttcgggatcttcaccaccaacatctggctgaagctgcgcgactcctacacccaggtctgcgaccaccggctcatgagcgccgccatcaaggactcccgcgcggtgcacgccgacatgggctactggatcgagagcgagaagaacgagacgtggaagctggcccgggcctccttcatcgaggtgaagacctgcatctggcccaagagccacaccctgtggtccaacggcgtcctcgagagcgagatgatcatccccaagatctacgggggcccgatctcccagcacaactaccgccccgggtacttcacccagacggcgggcccctggcacctggggaagctggagctcgacttcgacctgtgcgagggcaccaccgtggtggtcgacgagcagtgcggcaaccgggggccgagcctgcgcaccacgaccgtgaccggcaagatcatccacgagtggtgctgccggtcctgcaccctgccgcccctgcgcttcaagggggaggacggctgctggtacgggatggagatccggcccgtgaaggagaaggaggagaacctggtcaagagcatggtgagcgccggctccggcgaggtggacagcttctccctcgggctgctgtgcatcagcatcatgatcgaggaggtcatgcgctcccggtggagccgcaagatgctcatgacgggcaccctggccgtgttcctgctcctgaccatggggcagctgacctggaacgacctcatccggctgtgcatcatggtgggcgccaacgcctccgacaagatggggatgggcacgacctacctggccctcatggccaccttccgcatgcgcccgatgttcgccgtcgggctgctgttccgggggctcaccagccgcgaggtgctgctgctcacggtcggcctgtccctggtggccagcgtggagctccccaactccctggaggagctgggggacggcctcgccatgggcatcatgatgctgaagctgctcaccgacttccagagccaccagctgtgggcgaccctgctctccctgaccttcgtcaagacgaccttcagcctgcactacgcctggaagaccatggccatgaccctctccatcgtgagcctgttccccctgtgcctctccacgaccagccagaagaccacctggctgcccgtgctgctcgggtccctgggctgcaagccgctgaccatgttcctcatcacggagaacaagatctgggggcggaagtcctggcccctgaacgagggcatcatggccgtcgggatcgtgagcatcctgctctccagcctgctgaagaacgacgtgcccctcgccggccccctgatcgcgggcgggatgctgatcgcctgctacgtcatctccggcagctccgccgacctcagcctggagaaggccgcggaggtgtcctgggaggaggaggccgagcacagcggggcctcccacaacatcctggtggaggtccaggacgacggcaccatgaagatcaaggacgaggagcgcgacgacaccatcaccatcctcctgaaggccacgctgctcgccatcagcggggtgtacccgatgtccatccccgcgaccctgttcgtgtggtacttctggcagaagaagaagcagcggagcggcgtcctgtgggacacccccagcccgcccgaggtggagcgcgccgtgctcgacgacggcatctaccggatcctgcagcgcgggctgctgggccggagccaggtcggggtgggcgtgttccaggagggggtcttccacaccatgtggcacgtgacgcgcggcgccgtgctcatgtaccagggcaagcggctggagccctcctgggccagcgtcaagaaggacctgatctcctacgggggcgggtggcgcttccagggcagctggaacaccggggaggaggtccaggtgatcgccgtcgagcccggcaagaaccccaagaacgtgcagaccgcgcccggcaccttcaagacgtccgagggggaggtgggcgccatcgccctcgacttcaagcccgggaccagcggcagccccatcgtcaaccgggagggcaagatcgtggggctgtacggcaacggggtggtcaccacctccggcacgtacgtgagcgccatcgcccaggcgaaggcctcccaggaggggcccctgccggagatcgaggacgaggtgttccgcaagcggaacctcaccatcatggacctgcaccccggcagcggcaagacccgccggtacctgcccgccatcgtccgcgaggccatcaagcggaagctccgcaccctggtgctggccccgacgcgggtggtcgcgtccgagatggccgaggccctcaaggggatgcccatccgctaccagaccaccgccgtcaagagcgagcacaccggcaaggagatcgtggacctgatgtgccacgcgacgttcaccatgcgcctgctctcccccgtccgggtgcccaactacaacatgatcatcatggacgaggcccacttcaccgacccggccagcatcgccgcccgcgggtacatctccacccgggtgggcatgggggaggcggccgccatcttcatgacggccacgccgcccggcagcgtcgaggccttcccccagtccaacgcggtgatccaggacgaggagaaggacatcccggagcgcagctggaactccggctacgactggatcaccgacttccccgggaagaccgtgtggttcgtccccagcatcaagtccggcaacgacatcgccaactgcctgcggaagaacgggaagcgcgtgatccagctgagccggaagacgttcgacaccgagtaccagaagaccaagaacaacgactgggactacgtggtcaccacggacatctccgagatgggcgccaacttccgcgccgaccgggtgatcgacccccgccggtgcctcaagccggtcatcctgaaggacgggcccgagcgcgtgatcctggccggccccatgcccgtgaccgtcgcgagcgccgcccagcggcgcggccggatcgggcgcaaccagaacaaggagggcgaccagtacatctacatggggcagccgctcaacaacgacgaggaccacgcccactggaccgaggcgaagatgctgctggacaacatcaacacccccgagggcatcatccccgccctcttcgagcccgagcgggagaagtccgccgccatcgacggggagtaccgcctgcggggcgaggcccgcaagacgttcgtggagctgatgcgccggggcgacctcccggtgtggctgagctacaaggtcgcgagcgaggggttccagtactccgaccgccggtggtgcttcgacggcgagcgcaacaaccaggtgctggaggagaacatggacgtggagatctggaccaaggagggggagcggaagaagctccgcccccggtggctggacgcccgcacctacagcgaccccctggccctccgggagttcaaggagttcgccgccggccgccggtccgtcagcggcgacctgatcctggagatcgggaagctcccccagcacctgacccagaaggcgcagaccgccctggacaacctcgtgatgctgcacaactccgagcagggcgggaaggcctaccgccacgccatggaggagctgccggacacgatcgagaccctcatgctgctggccctcatcgcggtgctgaccggcggggtcaccctgttcttcctcagcggcaagggcctggggaagacgtccatcggcctgctctgcgtgatgagctccagcgccctgctgtggatggcctccgtggagccccactggatcgccgcgagcatcatcctcgagttcttcctgatggtcctgctcatccccgagcccgaccggcagcgcaccccgcaggacaaccagctggcctacgtggtgatcgggctcctcttcatgatcctgaccgtcgccgccaacgagatgggcctgctcgagaccacgaagaaggacctggggatcggccacgccgcggccgagaaccaccaccacgccgccatgctggacgtggacctccaccccgcctccgcgtggaccctgtacgccgtggccaccaccatcatcacgcccatgatgcggcacaccatcgagaacaccaccgccaacatcagcctgacggccatcgcgaaccaggccgccatcctcatgggcctggacaaggggtggccgatctccaagatggacatcggcgtccccctgctcgccctggggtgctacagccaggtgaaccccctgaccctcaccgccgcggtgctgatgctggtcgcccactacgccatcatcggccccgggctccaggccaaggcgacccgcgaggcccagaagcggacggccgccggcatcatgaagaacccgaccgtggacggcatcgtggccatcgacctggaccccgtcgtgtacgacgcgaagttcgagaagcagctggggcagatcatgctcctgatcctgtgcacctcccagatcctcctgatgcgcaccacgtgggccctgtgcgagagcatcaccctcgccaccggccccctgaccacgctgtgggaggggtcccccggcaagttctggaacaccaccatcgccgtgagcatggccaacatcttccggggcagctacctcgcgggggccggcctggccttctccctgatgaagtccctcgggggcgggcgccggggcaccggcgcccagggggagacgctgggcgagaagtggaagcgccagctgaaccagctctccaagagcgagttcaacacctacaagcgctccgggatcatggaggtcgaccggagcgaggccaaggagggcctgaagcgcggggagaccaccaagcacgcggtgtcccggggcacggccaagctgcgctggttcgtggagcggaacctcgtcaagccggagggcaaggtgatcgacctggggtgcggccgcgggggctggagctactactgcgccgggctgaagaaggtgaccgaggtcaagggctacaccaagggcgggcccggccacgaggagcccatccccatggccacctacgggtggaacctggtgaagctccactccggcaaggacgtgttcttcatcccgcccgagaagtgcgacaccctgctgtgcgacatcggggagagctcccccaaccccacgatcgaggagggccggaccctccgcgtcctgaagatggtggagccgtggctgcggggcaaccagttctgcatcaagatcctcaacccctacatgcccagcgtggtcgagaccctggagcagatgcagcgcaagcacgggggcatgctggtgcggaaccccctctcccgcaacagcacccacgagatgtactgggtgtcctgcgggacgggcaacatcgtcagcgcggtgaacatgacctcccggatgctgctgaaccgcttcaccatggcccaccggaagccgacctacgagcgcgacgtggacctcggcgccgggacgcggcacgtcgccgtggagcccgaggtggccaacctggacatcatcggccagcgcatcgagaacatcaagaacgagcacaagagcacctggcactacgacgaggacaacccctacaagacctgggcgtaccacgggtcctacgaggtccggcccagcggcagcgcctccagcatggtgaacggggtcgtgcgcctgctcaccaagccgtgggacgtgatccccatggtcacgcagatcgccatgaccgacaccacccccttcggccagcagcgcgtgttcaaggagaaggtggacacgcggacccccaaggccaagcgcggcaccgcccagatcatggaggtcaccgcgaagtggctgtgggggttcctgtcccggaacaagaagccgcgcatctgcacgcgggaggagttcacccgcaaggtgcggagcaacgccgccatcggcgccgtgttcgtcgacgagaaccagtggaactccgccaaggaggcggtggaggacgagcgcttctgggacctcgtgcaccgggagcgcgagctgcacaagcaggggaagtgcgcgacctgcgtctacaacatgatgggcaagcgggagaagaagctgggggagttcggcaaggccaagggcagccgcgccatctggtacatgtggctcggggcgcggttcctggagttcgaggccctgggcttcatgaacgaggaccactggttctcccgcgagaacagcctctccggggtggagggcgaggggctgcacaagctgggctacatcctccgggacatcagcaagatccccggcgggaacatgtacgccgacgacaccgccggctgggacacgcgcatcaccgaggacgacctgcagaacgaggccaagatcaccgacatcatggagcccgagcacgcgctgctcgccacctccatcttcaagctgacgtaccagaacaaggtggtccgggtgcagcgcccggccaagagcgggaccgtgatggacgtcatctcccggcgcgaccagcggggcagcggccaggtggggacctacggcctgaacaccttcacgaacatggaggcccagctcatccgccagatggagtccgaggggatcttcagcccctccgagctggagacccccaacctggccggccgcgtgctcgactggctggagaagcacgggatcgagcggctgaagcgcatggcgatcagcggcgacgactgcgtcgtgaagcccatcgacgaccggttcgccaccgccctcaccgccctgaacgacatgggcaaggtgcgcaaggacatcccgcagtgggagcccagcaaggggtggaacgactggcagcaggtccccttctgctcccaccacttccaccagctgatcatgaaggacggccgggagatcgtggtgccctgccgcagccaggacgagctcgtcgggcgggcccgcgtgtcccagggcgcggggtggagcctgcgggagacggcctgcctgggcaagtcctacgcccagatgtggcagctcatgtacttccaccgccgggacctgcgcctggccgccaacgcgatctgcagcgccgtgccggtcgactgggtgcccacctcccggaccacctggagcatccacgcccaccaccagtggatgaccacggaggacatgctctccgtgtggaaccgcgtctggatcgaggagaacccctggatggaggacaagacccacgtgagctcctgggaggacgtgccctacctgggcaagcgggaggaccagtggtgcgggagcctgatcggcctcaccgcccgcgcgacctgggccacgaacatccaggtcgccatcaaccaggtgcggcgcctgatcgggaacgagaactacctggactacatgacctccatgaagcggttcaagaacgagagcgacccggagggcgccctctggtga

SEQ ID NO: 7917 - RNA, 9879 nt, synthetic construct
  misc_feature 1..9879: note = derived and/or modified CDS sequence (opt1) from DENV-1__LC016760__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgctaccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcaccctggccgtgttcttcctgctcatcatggggcagctgacgtggaacgacctgatccgcctctgcatcatggtcggcgcgaacgccagcgaccgcatggggatgggcaccacctacctggccctgatggccaccttcaagatgcggccgatgttcgccgtgggcctcctgttccgccggctgacgtcccgcgaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatcgcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccggaagtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctgtacggcaacggggtcgtgaccaccagcggcacctacgtgagcgccatcgcccaggccaaggcgtcccaggaggggccgctccccgagatcgaggacgaggtcttccgcaagcggaacctgacgatcatggacctgcaccccggcagcgggaagacccgccggtacctcccggccatcgtgcgcgaggccatcaagcggaagctgcgcaccctgatcctcgcccccacccgcgtggtcgcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcatcctcgccggccccatgccggtgacggtcgcctccgccgcgcagcgccgggggcgcatcggccggaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagacgctgatgctgctcgccctgatcgccgtgctgaccggcggggtcaccctcttcttcctgtccggcaaggggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccgccagcggacgccccaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgcctccgcgtggaccctgtacgccgtggccacgaccatcatcaccccgatgatgcgccacaccatcgagaacacgaccgccaacatcagcctcaccgccatcgcgaaccaggccgccatcctgatggggctggacaagggctggcccatctccaagatggacatcggcgtccccctcctggccctggggtgctacagccaggtgaaccccctcaccctgacggcggccgtgctgatgctcgtcgcccactacgccatcatcggcccggggctgcaggccaaggcgacccgggaggcccagaagcgcaccgccgccggcatcatgaagaaccccaccgtggacgggatcgtggccatcgacctggaccccgtcgtgtacgacgcgaagttcgagaagcagctcggccagatcatgctgctgatcctctgcacgtcccagatcctgctgatgcgcaccacctgggccctctgcgagagcatcaccctggccacgggccccctgaccaccctctgggaggggtccccgggcaagttctggaacaccacgatcgccgtgagcatggccaacatcttccgggggtcctacctggcgggcgccggcctggccttcagcctcatgaagtccctcgggggcgggcgccgggggaccggggcccagggcgagaccctgggcgagaagtggaagcgccagctcaaccagctgtccaagagcgagttcaacacctacaagcggtccgggatcatggaggtcgaccgcagcgaggcgaaggagggcctgaagcgcggggagacgaccaagcacgccgtgtcccgcggcaccgccaagctccggtggttcgtggagcgcaacctggtcaagcccgaggggaaggtgatcgacctgggctgcggccgcgggggctggagctactactgcgccgggctgaagaaggtgaccgaggtcaagggctacacgaagggcggccccggccacgaggagcccgtgccgatggccacctacgggtggaacctcgtgaagctgcactccggcaaggacgtcttcttcatcccgcccgagaagtgcgacaccctgctctgcgacatcggggagagctcccccaacccgaccatcgaggagggccgcacgctgcgggtgctgaagatggtggagccctggctccgcgggaaccagttctgcatcaagatcctgaacccctacatgcccagcgtcgtggagaccctggagcagatgcagcggaagcacggcggcatgctcgtgcgcaacccgctgtcccggaacagcacccacgagatgtactgggtctcctgcgggaccggcaacatcgtgagcgcgatcaacatgacctcccgcatgctgctcaaccggttcacgatggcccaccgcaagcccacctacgagcgcgacgtggacctgggggccggcacccggcacgtcgccgtggagcccgaggtggccaacctggacatcatcggccagcgcatcgagaacatcaagtgcgagcacaagagcacctggcactacgacgaggacaacccctacaagacgtgggcgtaccacgggtcctacgaggtcaagccgagcggctccgccagcagcatggtgaacggggtcgtgaagctcctgaccaagccctgggacgtgatccccatggtcacccagatcgccatgaccgacacgacccccttcggccagcagcgggtgttcaaggagaaggtggacacccgcaccccgaaggccaagcgggggacggcccagatcatggaggtcaccgcgcgctggctgtggggcttcctctcccggaacaagaagccccgcatctgcacccgggaggagttcacccgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcaggggaagtgcgccacgtgcgtctacaacatgatgggcaagcgggagaagaagctcggggagttcggcaaggccaaggggagccgcgccatctggtacatgtggctgggcgcgcggttcctggagttcgaggccctcggcttcatgaacgaggaccactggttctcccgcgagaacagcctgtccggggtggagggcgaggggctgcacaagctcggctacatcctgcgggacatcagcaagatctccgggggcaacatgtacgccgacgacaccgccggctgggacacccgcatcaccgaggacgacctgcagaacgaggccaagatcacggagatcatggagcccgagcacgcgcagctcgccaaggccatcttcaagctgacctaccagaacaaggtggtccgggtgcagcgcccggccaagaacgggaccgtgatggacgtcatcagccgccgggaccagcgcggctccggccaggtggggacctacggcctgaacacgttcaccaacatggaggcccagctcatccggcagatggagagcgaggggatcttctcccccagcgagctggagacccccaacctggcggagcgcgtgctcgactggctggagaagtacggcgtcgagcggctgaagcgcatggccatctccggggacgactgcgtggtgaagcccatcgacgaccggttcgccaccgccctcacggccctgaacgacatgggcaaggtccgcaaggacatcccgcagtgggagcccagcaaggggtggaacgactggcagcaggtccccttctgctcccaccacttccaccagctgatcatgaaggacggccgggagatcgtggtcccctgccgcaaccaggacgagctcgtgggccgggcgcgcgtgagccagggggccggctggagcctgcgggagaccgcctgcctggggaagtcctacgcccagatgtggcagctcatgtacttccaccgccgggacctgcgcctggcggccaacgccatctgcagcgccgtcccggtggactgggtgcccacctcccggaccacgtggagcatccacgcccaccaccagtggatgaccaccgaggacatgctctccgtctggaaccgcgtgtggatcgaggagaacccctggatgaaggacaagacccacatcagctcctgggaggacgtgccctacctgggcaagcgggaggaccagtggtgcgggagcctgatcggcctcacggcgcgcgccacctgggccaccaacatccaggtcgccatcaaccaggtgcgccggctgatcggcaacgagaactacctggactacatgacctccatgaagcgcttcaagaacgagagcgacccggagggggccctctggtga

SEQ ID NO: 7918 - RNA, 9879 nt, synthetic construct
  misc_feature 1..9879: note = derived and/or modified CDS sequence (opt1) from DENV-1__LC128301__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagacctccgccggggtgaacatgtgcaccctgatcgccatggacctgggcgagctctgcgaggacaccatgacctacaagtgcccccgcatcaccgagaccgagcccgacgacgtggactgctggtgcaacgccaccgagacctgggtcacctacgggacctgcagccagaccggcgagcaccggcgcgacaagcggtccgtggccctggcgccccacgtgggcctggggctcgagacccgcaccgagacctggatgagctccgagggcgcgtggcggcagatccagaaggtcgagacgtgggccctgcgccaccccgggttcaccgtgatcgccctgttcctcgcccacgcgatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggccaaggacaagcccacgctcgacatcgagctgctgaagaccgaggtcaccaaccccgccgtgctccggaagctgtgcatcgaggcgaagatcagcaacaccacgaccgactcccgctgccccacccagggcgaggccaccctggtggaggagcaggacacgaacttcgtctgccggcgcaccttcgtggaccggggctgggggaacggctgcggcctgttcggcaaggggagcctgatcacgtgcgccaagttcaagtgcgtgaccaagctggagggcaagatcgtccagtacgagaacctcaagtactccgtgatcgtgacggtccacaccggcgaccagcaccaggtggggaacgagaccaccgagcacggcaccacggccaccatcacgccccaggcccccaccagcgagatccagctgacggactacggggcgctgaccctcgactgcagcccccgcaccggcctggacttcaacgagatggtcctgctcaccatgaaggagaagtcctggctggtgcacaagcagtggttcctggacctcccgctgccctggacgtccggggccagcaccagccaggagacctggaaccggcaggacctgctcgtgaccttcaagacggcccacgccaagaagcaggaggtcgtggtgctgggctcccaggagggcgccatgcacaccgcgctgaccggggccaccgagatccagacgagcggcaccaccaccatcttcgccgggcacctcaagtgccgcctgaagatggacaagctgacgctcaagggcgtctcctacgtgatgtgcaccgggagcttcaagctggagaaggaggtggccgagacccagcacggcaccgtcctggtccaggtgaagtacgagggcacggacgccccctgcaagatccccttctccagccaggacgagaagggggtcacccagaacggccggctgatcaccgcgaacccgatcgtgaccgacaaggagaagcccgtgaacatcgaggccgagccgcccttcggggagtcctacctcgtcgtgggcgccggcgagaaggccctgaagctgagctggttcaagaaggggtccagcatcggcaagatgttcgaggcgacggcccgcggggcccggcgcatggccatcctcggcgacaccgcctgggacttcgggtccatcggcggcgtgttcaccagcgtcgggaagctgatccaccagatcttcggcaccgcgtacggggtgctgttctccggcgtgagctggacgatgaagatcgggatcggcatcctcctgacctggctgggcctcaactcccgcagcacctccctgagcatgacctgcatcgccgtcgggatggtgacgctgtacctcggcgtgatggtccaggccgactccgggtgcgtgatcaactggaagggccgggagctgaagtgcgggagcggcatcttcgtgaccaacgaggtccacacctggaccgagcagtacaagttccaggccgacagcccgaagcgcctgtccgccgcgatcggcaaggcctgggaggagggggtgtgcggcatccggagcgccacccgcctcgagaacatcatgtggaagcagatctccaacgagctgaaccacatcctgctcgagaacgacatgaagttcacggtggtcgtgggggacgtgaacggcatcctggcccaggggaagaagatgatccggccccagcccatggagcacaagtacagctggaagtcctggggcaaggccaaggtcatcggcgcggacgtgcagaacaccaccttcatcatcgacgggcccaacaccccggagtgccccgacgaccagcgcgcctggaacatctgggaggtggaggactacggcttcgggatcttcacgaccaacatctggctgaagctccgggacagctacacccaggtctgcgaccaccgcctgatgtccgccgccatcaaggacagcaaggcggtgcacgccgacatgggctactggatcgagtccgagaagaacgagacctggaagctgacgcgggccagcttcatcgaggtgaagacctgcatctggcccaagtcccacaccctctggagcaacggcgtcctggagtccgagatgatcatccccaagacctacgggggcccgatcagccagcacaactaccgccccgggtacttcacgcagaccgccggcccctggcacctggggaagctcgagctggacttcggcctgtgcgagggcaccaccgtggtggtcgacgagcactgcgggaaccggggcccgtccctccgcacgaccaccgtgaccgggaagatcatccacgagtggtgctgccggagctgcacgctgccgcccctgcgcttcaagggcgaggacgggtgctggtacggcatggagatccggcccgtgaaggagaaggaggagaacctcgtccgctccatggtgagcgccggcagcggggaggtggactccttcagcctgggcctgctctgcatctccatcatgatcgaggaggtcatgcggagccgctggtcccggaagatgctgatgaccgggaccctggcggtgttcctcctgctgatcatgggccagctcacctggaacgacctgatccgcctgtgcatcatggtgggggccaacgccagcgacaagatgggcatgggcacgacctacctcgccctgatggccaccttccgcatgcggccgatgttcgccgtcgggctcctcttccgccggctgacctcccgcgaggtgctgctcctgacggtcgggctgagcctcgtggcctccgtggagctgcccaacagcctggaggagctcggggacggcctggccatgggcatcatgatgctgaagctcctgaccgacttccagtcccaccagctgtgggccgccctcctgagcctgaccttcgtcaagaccacgttctccctccactacgcgtggaagaccatggccatgatcctgagcatcatctccctgttccccctctgcatgagcaccacctcccagaagacgacctggctgcccgtgctgctcgggagcctgggctgcaagccgctgaccatgttcctcatcaccgagaacaagatctgggggcggaagtcctggcccctgaacgagggcatcatggccgtggggatcgtcagcatcctgctcagctccctgctgaagaacgacgtgcccctcgccggccccctgatcgcgggcgggatgctgatcgcctgctacgtgatcagcggctccagcgccgacctctccctggagaaggccgccgaggtcagctgggaggaggaggcggagcactccggggccagccacaacatcctggtggaggtgcaggacgacggcaccatgaagatcaaggacgaggagcgcgacgacacgctcaccatcctgctgaaggccaccctcctggccatctccggggtctacccgatgagcatccccgccaccctgttcgtgtggtacttctggcagaagaagaagcagcggtccggcgtgctctgggacacgcccagcccgcccgaggtcgagcgcgcggtgctggacgacggcatctaccggatcctgcagcgcgggctgctcggcaagtcccaggtgggggtcggcgtgttccaggagggggtgttccacaccatgtggcacgtcacccggggcgccgtgctgatgtaccagggcaagcgcctggagcccagctgggcctccgtgaagaaggacctcatcagctacgggggcgggtggcggttccagggctcctggaacaccggggaggaggtccaggtgatcgccgtggagcccggcaagaaccccaagaacgtccagacggcccccggcaccttcaagacccccgagggggaggtgggcgcgatcgccctggacttcaagcccgggaccagcggctcccccatcgtgaaccgcgagggcaagatcgtcgggctgtacggcaacggggtggtgacgaccagcggcacctacgtcagcgccatcgcccaggccaaggcgtcccaggaggggccgctccccgagatcgaggacgaggtgttccggaagcgcaacctgaccatcatggacctgcaccccggcagcggcaagacgcggcgctacctcccggccatcgtgcgggaggccatcaagcgcaagctgcggaccctggtcctcgcccccacccgcgtggtggcgtccgagatggccgaggccctgaaggggatgcccatccgctaccagaccacggccgtcaagagcgagcacaccggcaaggagatcgtggacctgatgtgccacgccaccttcaccatgcggctcctgtcccccgtgcgcgtcccgaactacaacatgatcatcatggacgaggcgcacttcacggaccccgccagcatcgccgcccgggggtacatctccacccgcgtgggcatgggggaggccgcggccatcttcatgaccgccacgccgcccggcagcatggaggccttcccgcagtccaacgccgcgatccaggacgaggagcgggacatccccgagcgcagctggaactccggctacgactggatcacggacttccccgggaagaccgtgtggttcgtccccagcatcaagtccggcaacgacatcgccaactgcctgcggaagaacgggaagcgcgtggtgcagctcagccggaagaccttcgacaccgagtaccagaagacgaagaacaacgactgggactacgtcgtgaccaccgacatctccgagatgggcgccaacttccgcgccgaccgggtgatcgacccgcgccggtgcctgaagcccgtcatcctgaaggacgggcccgagcgcgtgatcctcgcgggccccatgccggtcaccgtggccagcgccgcccagcggcgcggccggatcgggcgcaaccagaacaaggagggcgaccagtacatctacatggggcagcccctgaacaacgacgaggaccacgcccactggacggaggcgaagatgctgctcgacaacatcaacacccccgagggcatcatccccgccctgttcgagccggagcgggagaagtccgccgccatcgacggggagtaccgcctgcgcggcgaggcccggaagaccttcgtggagctcatgcgccggggcgacctgcccgtctggctgagctacaaggtggcgtccgaggggttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacgtacagcgaccccctcgccctgcgggagttcaaggagttcgccgccggccgccggtccgtgagcggcgacctgatcctcgagatcgggaagctgccgcagcacctgacccagcgcgcgcagaacgccctcgacaacctggtgatgctgcacaactccgagcagggcgggaaggcctaccggcacgccatggaggagctccccgacaccatcgagaccctgatgctgctcgcgctgatcgccgtcctgaccggcggggtgaccctcttcttcctgagcggccgcggcctggggaagacctccatcggcctcctgtgcgtgatggccagctccgccctgctctggatggccagcgtcgagccccactggatcgcggcctccatcatcctggagttcttcctgatggtgctcctgatccccgagccggaccggcagcgcacgccccaggacaaccagctggcctacgtggtcatcgggctcctgttcatgatcctgaccgtggccgccaacgagatgggcctcctggagacgaccaagaaggacctggggatcggccacgtggcggccgagagccaccaccacgccgccatgctcgacgtcgacctgcaccccgcctccgcgtggaccctgtacgccgtggccaccacgatcatcaccccgatgatgcggcacaccatcgagaacaccacggccaacatcagcctcaccgccatcgcgaaccaggccgccatcctgatgggcctggacaaggggtggcccatctccaagatggacatcggcgtgcccctcctggccctggggtgctacagccaggtcaaccccctcaccctgaccgcggccgtgctgatgctcgtggcccactacgccatcatcggcccggggctgcaggccaaggcgacgcgcgaggcccagaagcggaccgccgccggcatcatgaagaaccccaccgtcgacggcatcgtggccatcgacctggaccccgtggtctacgacgcgaagttcgagaagcagctcgggcagatcatgctgctgatcctctgcacctcccagatcctgctgatgcgcacgacctgggccctctgcgagagcatcaccctggccaccggccccctgacgaccctctgggaggggtccccgggcaagttctggaacaccaccatcgccgtgagcatggccaacatcttccgcggctcctacctggcgggggccggcctggccttcagcctcatgaagtccctcgggggcgggcggcgcgggacgggcgcccagggggagaccctgggcgagaagtggaagcggcagctcaaccagctgtccaagagcgagttcaacacctacaagcgctccgggatcatggaggtggaccggagcgaggcgaaggagggcctgaagcgcggggagaccacgaagcacgccgtctcccggggcaccgccaagctccgctggttcgtggagcggaacctggtgaagcccgagggcaaggtcatcgacctggggtgcggccgcgggggctggagctactactgcgccgggctgaagaaggtgaccgaggtgaagggctacaccaagggcgggcccggccacgaggagcccatcccgatggccacgtacgggtggaacctcgtcaagctgtactccggcaaggacgtgttcttcacgccgcccgagaagtgcgacaccctgctctgcgacatcggggagagctcccccaacccgaccatcgaggagggccggaccctgcgcgtgctgaagatggtcgagccctggctccggggcaaccagttctgcatcaaggtgctgaacccctacatgcccagcgtggtcgagacgctggagcagatgcagcgcaagcacgggggcatgctcgtgcggaacccgctgtcccgcaacagcacccacgagatgtactgggtgtcctgcgggaccggcaacatcgtcagcgcggtgaacatgacctcccggatgctgctcaaccgcttcacgatgacccaccggaagcccacctacgagaaggacgtggacctgggcgccgggacccgccacgtcgccgtggagcccgaggtggccaacctggacatcatcggccagcgcatcgagaacatcaagaacgagcacaagagcacgtggcactacgacgaggacaacccctacaagacctgggcctaccacgggtcctacgaggtcaagccgagcggctccgcgagcagcatggtgaacggggtcgtgcggctcctgaccaagccctgggacgtgatccccatggtcacccagatcgccatgacggacaccacccccttcggccagcagcgcgtgttcaaggagaaggtggacacccggacgccgaaggccaagcgcggcaccgcccagatcatggaggtcaccgcccggtggctgtgggggttcctctcccgcaacaagaagccccggatctgcacccgcgaggagttcacgcggaaggtgcgcagcaacgcggccatcggcgccgtgttcgtcgacgagaaccagtggaactccgccaaggaggcggtggaggacgagcggttctgggacctggtgcaccgcgagcgggagctgcacaagcaggggaagtgcgcgacctgcgtctacaacatgatgggcaagcgcgagaagaagctcggggagttcggcaaggccaagggcagccgggccatctggtacatgtggctgggggcccgcttcctggagttcgaggcgctcggcttcatgaacgaggaccactggttctcccgggagaacagcctgtccggggtggagggcgaggggctgcacaagctcggctacatcctgcgcgacatcagcaagatccccggcgggaacatgtacgccgacgacaccgccggctgggacacccggatcacggaggacgacctgcagaacgaggccaagatcaccgacatcatggagccggagcacgccctcctggcgacctccatcttcaagctgacctaccagaacaaggtggtccgcgtgcagcggcccgccaagaacgggacggtgatggacgtcatcagccgccgcgaccagcggggctccggccaggtggggacctacggcctcaacaccttcaccaacatggaggcccagctgatccgccagatggagagcgaggggatcttcctgccctccgagctcgagacgcccaacctggccgagcgggtgctggactggctcgagaagcacggcaccgagcgcctgaagcggatggccatcagcggggacgactgcgtcgtgaagccgatcgacgaccgcttcgcgaccgccctgaccgccctcaacgacatgggcaaggtgcggaaggacatcccccagtgggagccctccaagggctggaacgactggcagcaggtccccttctgcagccaccacttccaccagctgatcatgaaggacgggcgcgagatcgtggtgccgtgccggaaccaggacgagctggtcggccgcgcccgggtgtcccagggggccggctggagcctccgcgagacggcgtgcctgggcaagagctacgcccagatgtggcagctgatgtacttccaccggcgcgacctccggctggccgccaacgcgatctgctccgccgtgcccgtcgactgggtgcccaccagccgcaccacctggtccatccacgcccaccaccagtggatgaccacggaggacatgctgagcgtgtggaaccgggtctggatcgaggagaacccctggatggaggacaagacccacgtgtccagctgggaggacgtgccgtacctcggcaagcgcgaggaccagtggtgcggctccctgatcgggctgaccgcccgggccacctgggcgacgaacatccaggtcgccatcaaccaggtgcgccgcctcatcggcaacgagaactacctggactacatgaccagcatgaagcggttcaagaacgagtccgaccccgagggggccctgtggtga

SEQ ID NO: 7919 - RNA, 9879 nt, synthetic construct
  misc_feature 1..9879: note = derived and/or modified CDS sequence (opt1) from DENV-1__LC011945__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgctaccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcaccctggccgtgttcttcctgctcatcatggggcagctgacgtggaacgacctgatccgcctctgcatcatggtcggcgcgaacgccagcgaccgcatggggatgggcaccacctacctggccctgatggccaccttcaagatgcggccgatgttcgccgtgggcctcctgttccgccggctgacgtcccgcgaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatcgcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccggaagtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctgtacggcaacggggtcgtgaccaccagcggcacctacgtgagcgccatcgcccaggccaaggcgtcccaggaggggccgctccccgagatcgaggacgaggtcttccgcaagcggaacctgacgatcatggacctgcaccccggcagcgggaagacccgccggtacctcccggccatcgtgcgcgaggccatcaagcggaagctgcgcaccctgatcctcgcccccacccgcgtggtcgcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctgaaggacgggtccgagcgggtcatcctcgccggccccatgcccgtgacggtcgccagcgccgcgcagcgccgggggcgcatcggccggaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgcgagaagtccgccgcgatcgacggggagtaccgcctgcggggcgaggcccgcaagaccttcgtggagctcatgcggcgcggggacctgccggtgtggctgagctacaaggtcgccagcgagggcttccagtactccgaccggcgctggtgcttcgacggcgagcggaacaaccaggtgctcgaggagaacatggacgtggagatctggacgaaggagggggagcgcaagaagctgcggccccgctggctggacgcccggacctacagcgaccccctcgccctgcgcgagttcaaggagttcgcggccggccggcgctccgtcagcggggacctgatcctcgagatcggcaagctgccccagcacctgacccagcgggcccagaacgccctcgacaacctggtgatgctgcacaactccgagcagggcgggcgcgcgtaccggcacgccatggaggagctcccggacaccatcgagacgctgatgctgctcgccctgatcgccgtgctgaccggcggggtcaccctcttcttcctgagcggcaaggggctgggcaagacctccatcggcctcctgtgcgtgatggccagctccgtgctgctctggatggcgagcgtcgagccccactggatcgccgcctccatcatcctggagttcttcctgatggtgctcctgatccccgagcccgaccgccagcggaccccgcaggacaaccagctggcctacgtggtcatcgggctcctgttcatgatcctgacggtggccgcgaacgagatgggcctcctggagaccaccaagaaggacctggggatcggccacgtggccgtcgagaaccaccaccacgccgccatgctcgacgtggacctgcaccccgccagcgcgtggaccctgtacgccgtggccacgaccatcatcacccccatgatgcgccacaccatcgagaacacgaccgccaacatctccctcaccgccatcgcgaaccaggccgccatcctgatggggctggacaagggctggccgatcagcaagatggacatcggcgtccccctcctggccctggggtgctactcccaggtgaaccccctcaccctgacggcggccgtgctgatgctcgtcgcccactacgccatcatcggccccgggctgcaggccaaggcgacccgggaggcccagaagcgcaccgccgccggcatcatgaagaacccgaccgtggacgggatcgtggccatcgacctggaccccgtcgtgtacgacgcgaagttcgagaagcagctcggccagatcatgctgctgatcctctgcacgagccagatcctgctgatgcgcaccacctgggccctctgcgagtccatcaccctggccacgggccccctgaccaccctctgggaggggagccccggcaagttctggaacaccacgatcgccgtgtccatggccaacatcttccgggggagctacctggcgggcgccggcctggccttcagcctcatgaagtccctcgggggcgggcgccgggggaccggggcccagggcgagaccctgggcgagaagtggaagcgccagctcaaccagctgagcaagtccgagttcaacacctacaagcggagcgggatcatggaggtcgaccgctccgaggcgaaggagggcctgaagcgcggggagacgaccaagcacgccgtgagccgcggcaccgccaagctccggtggttcgtggagcgcaacctggtcaagccggaggggaaggtgatcgacctgggctgcggccgcggcgggtggtcctactactgcgccgggctgaagaaggtgaccgaggtcaaggggtacacgaagggcggccccggccacgaggagcccgtgcccatggccacctacgggtggaacctcgtgaagctgcacagcggcaaggacgtcttcttcatcccgcccgagaagtgcgacaccctgctctgcgacatcggggagtccagccccaaccccaccatcgaggagggccgcacgctgcgggtgctgaagatggtggagccgtggctccgcgggaaccagttctgcatcaagatcctgaacccctacatgccctccgtcgtggagaccctggagcagatgcagcggaagcacggcggcatgctcgtgcgcaaccccctgagccggaactccacccacgagatgtactgggtcagctgcgggaccggcaacatcgtgtccgcgatcaacatgaccagccgcatgctgctcaaccggttcacgatggcccaccgcaagccgacctacgagcgcgacgtggacctgggggccggcacccggcacgtcgccgtggagcccgaggtggccaacctggacatcatcggccagcgcatcgagaacatcaagtgcgagcacaagtccacctggcactacgacgaggacaacccctacaagacgtgggcgtaccacgggagctacgaggtcaagccctccggcagcgccagctccatggtgaacggggtcgtgaagctcctgaccaagccgtgggacgtgatccccatggtcacccagatcgccatgaccgacacgacccccttcggccagcagcgggtgttcaaggagaaggtggacacccgcacccccaaggccaagcgggggacggcccagatcatggaggtcaccgcgcgctggctgtggggcttcctcagccggaacaagaagccgcgcatctgcacccgggaggagttcacccgcaaggtgcggtccaacgccgccatcggcgccgtgttcgtcgacgagaaccagtggaacagcgcgaaggaggccgtggaggacgagcgcttctgggacctggtgcaccgggagcgcgagctgcacaagcaggggaagtgcgccacgtgcgtctacaacatgatgggcaagcgggagaagaagctcggggagttcggcaaggccaaggggtcccgcgccatctggtacatgtggctgggcgcgcggttcctggagttcgaggccctcggcttcatgaacgaggaccactggttcagccgcgagaactccctgagcggggtggagggcgaggggctgcacaagctcggctacatcctgcgggacatctccaagatcagcgggggcaacatgtacgccgacgacaccgccggctgggacacccgcatcaccgaggacgacctgcagaacgaggccaagatcacggagatcatggagcccgagcacgcgcagctcgccaaggccatcttcaagctgacctaccagaacaaggtggtccgggtgcagcgccccgccaagaacgggaccgtgatggacgtcatctcccgccgggaccagcgcggcagcggccaggtggggacctacggcctgaacacgttcaccaacatggaggcccagctcatccggcagatggagtccgaggggatcttcagcccgtccgagctggagacccccaacctggcggagcgcgtgctcgactggctggagaagtacggcgtcgagcggctgaagcgcatggccatcagcggggacgactgcgtggtgaagcccatcgacgaccggttcgccaccgccctcacggccctgaacgacatgggcaaggtccgcaaggacatcccccagtgggagccgtccaaggggtggaacgactggcagcaggtccccttctgcagccaccacttccaccagctgatcatgaaggacggccgggagatcgtggtcccctgccgcaaccaggacgagctcgtgggccgggcgcgcgtgagccagggggccggctggtccctgcgggagaccgcctgcctgggcaagagctacgcccagatgtggcagctcatgtacttccaccgccgggacctgcgcctggcggccaacgccatctgctccgccgtccccgtggactgggtgccgaccagccggaccacgtggtccatccacgcccaccaccagtggatgaccaccgaggacatgctcagcgtctggaaccgcgtgtggatcgaggagaacccctggatgaaggacaagacccacatctccagctgggaggacgtgccctacctgggcaagcgggaggaccagtggtgcgggtccctgatcggcctcacggcgcgcgccacctgggccaccaacatccaggtcgccatcaaccaggtgcgccggctgatcggcaacgagaactacctggactacatgaccagcatgaagcgcttcaagaacgagtccgaccccgagggggccctctggtga

SEQ ID NO: 7920 - RNA, 9879 nt, synthetic construct
  misc_feature 1..9879: note = derived and/or modified CDS sequence (opt1) from DENV-1__LC011949__SS-prME
  source 1..9879: mol_type = other RNA
agcgtgaccatgctgctgatgctggtgcccaccgccctggccttccacctcaccacccggggcggggagccccacatgatcgtgagcaagcaggagcggggcaagagcctgctgttcaagacctccgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgggacaagcggtccgtggccctcgcgccccacgtcggcctggggctggagacgcggaccgagacctggatgagctccgagggcgcctggaagcagatccagcgggtggagacctgggccctccggcaccccgggttcacggtgatcgccctgttcctggcgcacgccatcggcaccagcatcacccagaaggggatcatcttcatcctcctgatgctggtcaccccctccatggccatgcggtgcgtgggcatcggcagccgcgacttcgtggaggggctctccggcgccacgtgggtcgacgtggtgctggagcacgggagctgcgtcaccaccatggccaaggacaagcccaccctggacatcgagctcctgaagacggaggtgaccaaccccgcggtgctgcggaagctctgcatcgaggccaagatctccaacaccaccacggacagccgctgcccgacccagggcgaggccaccctggtcgaggagcaggacgccaacttcgtgtgccggcgcaccttcgtggaccggggctgggggaacggctgcgggctgttcggcaaggggtccctcatcacgtgcgccaagttcaagtgcgtcaccaagctggagggcaagatcgtgcagtacgagaacctgaagtacagcgtgatcgtcaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtgcacaagcagtggttcctggacctgcccctcccctggaccagcggggccagcacctcccaggagacgtggaaccggcaggacctgctggtcaccttcaagaccgcccacgcgaagaagcaggaggtggtggtcctcggcagccaggagggcgccatgcacaccgccctgacgggggccaccgagatccagacctccggcaccacgaccatcttcgccgggcacctgaagtgccgcctcaagatggacaagctgaccctgaagggcaccagctacgtgatgtgcacggggtccttcaagctcgagaaggaggtggcggagacccagcacggcaccgtcctggtgcagatcaagtacgagggcaccgacgccccctgcaagatccccttcagcacgcaggacgagaagggggtgacccagaacggccggctgatcaccgccaacccgatcgtcaccgacaaggagaagcccgtgaacatcgaggccgagccgcccttcggggagtcctacatcgtgatcggcgcgggcgagaaggccctgaagctcagctggttcaagaaggggtccagcatcggcaagatgttcgaggccacggcccgcggggcccggcgcatggcgatcctgggcgacaccgcctgggacttcgggtccatcggcggcgtcttcaccagcgtggggaagctggtgcaccagatcttcggcaccgcctacggggtcctcttctccggcgtgagctggacgatgaagatcgggatcggcgtgctgctgacctggctcggcctgaactcccgcagcacctccctgagcatgacctgcatcgccgtcgggctcgtgacgctgtacctgggcgtgatggtccaggccgacaccgggtgcgtgatcaactggaagggccgggagctcaagtgcgggtccggcatcttcgtgaccaacgaggtccacacctggaccgagcagtacaagttccaggcggacagcccgaagcgcctgagcgccgccatcggcaaggcctgggaggagggggtgtgcggcatccggtccgccacgcgcctggagaacatcatgtggaagcagatcagcaacgagctcaaccacatcctgctggagaacgacatgaagttcaccgtggtcgtgggggacgtggcgggcatcctcgcccaggggaagaagatgatccggccccagcccatggagtacaagtactcctggaagtcctggggcaaggccaagatcatcggcgccgacgtccagaacaccaccttcatcatcgacgggcccaacacgccggagtgccccgacgaccagcgcgcgtggaacatctgggaggtggaggactacggcttcgggatcttcaccaccaacatctggctgaagctgcgggactcctacacccaggtgtgcgaccaccgcctcatgagcgccgccatcaaggactccaaggccgtccacgccgacatgggctactggatcgagagcgagaagaacgagacgtggaagctggcgcgggcctccttcatcgaggtgaagacctgcatctggcccaagagccacaccctgtggtccaacggcgtgctcgagagcgagatgatcatccccaagatctacgggggcccgatctcccagcacaactaccgccccgggtacttcacccagacggccggcccctggcacctggggaagctggagctcgacttcgacctgtgcgagggcaccaccgtcgtggtggacgagcactgcggcaaccgggggccgagcctgcgcaccacgaccgtcaccggcaagatcatccacgagtggtgctgccggtcctgcaccctgccgcccctccgcttccgcggggaggacggctgctggtacgggatggagatccgccccgtgaaggagaaggaggagaacctggtcaagagcatggtctccgccggcagcggcgaggtggacagcttctccctcgggctgctgtgcatcagcatcatgatcgaggaggtgatgcggtcccgctggagccggaagatgctcatgacgggcaccctggccgtcttcttcctgctcatcatggggcagctgacctggaacgacctgatccgcctctgcatcatggtgggcgcgaacgcctccgaccgcatggggatgggcaccacgtacctggccctgatggccaccttcaagatgcggccgatgttcgccgtgggcctcctgttccgccggctgaccagccgcgaggtcctcctgctgaccatcgggctctccctggtggcgagcgtcgagctgcccaactccctcgaggagctgggcgacgggctggccatgggcatcatgatcctcaagctgctgacggacttccagagccaccagctctgggccaccctgctgtccctcaccttcatcaagaccacgttcagcctgcactacgcctggaagaccatggcgatggtgctgtccatcgtgagcctcttccccctgtgcctgtccaccaccagccagaagacgacctggctccccgtcctgctgggctccctcgggtgcaagccgctgaccatgttcctgatcgccgagaacaagatctggggccgcaagagctggcccctcaacgaggggatcatggccgtgggcatcgtgtccatcctgctgagcagcctcctgaagaacgacgtccccctggccgggcccctcatcgccggcggcatgctgatcgcgtgctacgtgatctccgggagctccgccgacctgagcctcgagaaggccgccgaggtgtcctgggaggaggaggccgagcacagcggcgcgtcccacaacatcctggtcgaggtgcaggacgacgggaccatgaagatcaaggacgaggagcgcgacgacaccctgacgatcctcctgaaggccaccctgctcgccgtgagcggcgtctacccgctgtccatccccgccaccctgttcgtgtggtacttctggcagaagaagaagcagcggagcggggtgctctgggacacccccagcccgcccgaggtcgagcgcgccgtgctggacgacggcatctaccggatcatgcagcgcggcctgctggggcggagccaggtgggcgtcggggtgttccaggagaacgtgttccacacgatgtggcacgtcacccgcggcgcggtgctcatgtaccaggggaagcggctggagccctcctgggccagcgtgaagaaggacctgatctcctacggcggcgggtggcgcctccagggcagctggaacaccggggaggaggtccaggtgatcgccgtggagcccggcaagaaccccaagaacgtccagaccgcccccgggacgttcaagacccccgagggcgaggtgggcgccatcgcgctggacttcaagcccgggacctccggcagccccatcgtgaaccgggaggggaagatcgtcggcctgtacggcaacggggtggtgaccacgtccggcacctacgtcagcgccatcgcccaggccaaggcgagccaggaggggccgctccccgagatcgaggacgaggtgttcaagaagcgcaacctgaccatcatggacctgcaccccggctccgggaagacccggcgctacctcccggccatcgtgcgggaggccatcaagcgcaagctgcggacgctgatcctcgcccccacccgcgtcgtggccagcgagatggcggaggccctgaagggcatgcccatccgctaccagaccaccgccgtgaagtccgagcacacgggcaaggagatcgtcgacctgatgtgccacgccaccttcaccatgcggctcctgagccccgtgcgcgtgccgaactacaacatgatcatcatggacgaggcccacttcaccgacccctccagcatcgcggcccgggggtacatctccacgcgcgtcggcatgggggaggccgccgccatcttcatgaccgcgacgccgcccggcagcgtggaggccttcccgcagtccaacgccgtgatccaggacgaggagcgggacatccccgagcgcagctggaactccgggtacgagtggatcaccgacttccccggcaagacggtctggttcgtgcccagcatcaagtccggcaacgacatcgccaactgcctgcggaagaacgggaagcgcgtgatccagctcagccggaagaccttcgacaccgagtaccagaagaccaagaacaacgactgggactacgtcgtgacgaccgacatctccgagatgggcgcgaacttccgcgccgaccgggtgatcgacccgcgccggtgcctgaagcccgtcatcctgaaggacgggcccgagcgcgtgatcctcgccggccccatgccggtcaccgtggccagcgccgcgcagcggcgcgggcggatcggccgcaaccacaacaaggagggcgaccagtacatctacatggggcagcccctgaacaacgacgaggaccacgcccactggaccgaggccaagatgctgctcgacaacatcaacacgcccgagggcatcatccccgccctgttcgagccggagcgggagaagtccgccgcgatcgacggggagtaccgcctgcgcggcgaggcccggaagaccttcgtggagctcatgcgccgcggggacctgcccgtctggctgagctacaaggtggcctccgagggcttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacctacagcgaccccctcgccctgcgggagttcaaggagttcgcggccggccgccggtccatcagcggggacctgatcctcgagatcggcaagctgccgcagcacctgacgcagcgcgcccagaacgccctcgacaacctggtgatgctgcacaactccgagcagggcgggcgggcgtaccgccacgccatggaggagctccccgacaccatcgagaccctgatgctgctcgccctgatcgccgtgctgaccggcggggtcaccctcttcttcctgagcggccgggggctgggcaagacgtccatcggcctcctgtgcgtgatggccagctccgtgctgctctggatggcgagcgtcgagccccactggatcgccgcctccatcatcctggagttcttcctgatggtgctcctgatccccgagccggaccgccagcggacgccccaggacaaccagctggcctacgtggtcatcgggctcctgttcatgatcctgaccgtggccgcgaacgagatgggcctcctggagaccacgaagaaggacctggggatcggccacgtggccgtcgagaaccaccaccacgccgccatgctcgacgtggacctgcaccccgccagcgcgtggaccctgtacgccgtggccaccaccatcatcacgccgatgatgcgccacaccatcgagaacaccaccgccaacatctccctcacggccatcgcgaaccaggccgccatcctgatggggctggacaagggctggcccatcagcaagatggacatcggcgtccccctcctggccctggggtgctactcccaggtgaaccccctcaccctgaccgcggccgtgctgatgctcgtcgcccactacgccatcatcggcccggggctgcaggccaaggcgacccgggaggcccagaagcgcacggccgccggcatcatgaagaaccccaccgtggacgggatcgtggccatcgacctggaccccgtcgtgtacgacgcgaagttcgagaagcagctcggccagatcatgctgctgatcctctgcaccagccagatcctgctgatgcgcaccacgtgggccctctgcgagtccatcaccctggccaccggccccctgaccacgctctgggaggggagcccgggcaagttctggaacaccaccatcgccgtgtccatggccaacatcttccgggggagctacctggcgggcgccggcctggccttctccctcatgaagtccctcgggggcgggcgccgggggaccggggcccagggcgagacgctgggcgagaagtggaagcgccagctcaaccagctgagcaagtccgagttcaacacctacaagcggagcgggatcatggaggtcgaccgctccgaggcgaaggagggcctgaagcgcggggagaccaccaagcacgccgtgagccgcggcacggccaagctccggtggttcgtggagcgcaacctggtcaagcccgaggggaaggtgatcgacctgggctgcggccgcgggggctggtcctactactgcgccgggctgaagaaggtgaccgaggtcaagggctacaccaagggcggccccggccacgaggagcccatcccgatggccacctacgggtggaacctcgtgaagctgcacagcggcaaggacgtgttcttcatcccgcccgagaagtgcgacacgctgctctgcgacatcggggagtccagccccaacccgaccatcgaggagggccgcaccctgcgggtcctgaagatggtggagccctggctccgcgggaaccagttctgcatcaagatcctgaacccctacatgccctccgtggtcgagaccctggagcagatgcagcggaagcacggcggcatgctcgtgcgcaacccgctgagccggaactccacccacgagatgtactgggtgagctgcgggacgggcaacatcgtctccgcggtgaacatgaccagccgcatgctgctcaaccggttcaccatggcccaccgcaagcccacctacgagcgcgacgtggacctgggggccggcacgcggcacgtcgccgtggagcccgaggtggccaacctggacatcatcggccagcgcatcgagaacatcaagcacgagcacaagtccacctggcactacgacgaggacaacccctacaagacctgggcgtaccacgggagctacgaggtcaagccgtccggcagcgcctccagcatggtgaacggggtcgtgaagctcctgaccaagccctgggacgtgatccccatggtcacgcagatcgccatgaccgacaccacccccttcggccagcagcgggtgttcaaggagaaggtggacacgcgcaccccgaaggccaagcgggggaccgcccagatcatggaggtcaccgcgcgctggctgtggggcttcctcagccggaacaagaagccccgcatctgcacgcgggaggagttcacccgcaaggtgcggtccaacgccgccatcggcgccgtgttcgtcgacgagaaccagtggaacagcgcgaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggtcccgcgccatctggtacatgtggctgggcgcgcggttcctggagttcgaggccctcggcttcatgaacgaggaccactggttcagccgcgagaactccctgagcggggtggagggcgaggggctgcacaagctcggctacatcctgcgggacatctccaagatccccgggggcaacatgtacgccgacgacaccgccggctgggacacgcgcatcaccgaggacgacctgcagaacgaggccaagatcaccgacatcatggagccggagcacgcgctcctggccaaggccatcttcaagctgacctaccagaacaaggtggtccgggtgcagcgccccgccaagaacgggacggtgatggacgtcatcagccgccgggaccagcgcggctccggccaggtggggacctacggcctcaacaccttcaccaacatggaggcccagctgatccggcagatggagagcgaggggatcttcctgccctccgagctcgagacgcccaacctggcggagcgcgtgctggactggctcgagaagtacggcgtcgagcggctgaagcgcatggccatcagcggggacgactgcgtggtgaagccgatcgacgaccggttcgccaccgccctgaccgccctcaacgacatgggcaaggtccgcaaggacatcccccagtgggagccctccaaggggtggaacgactggcagcaggtccccttctgcagccaccacttccaccagctgatcatgaaggacggccgggagatcgtggtcccgtgccgcaaccaggacgagctggtgggccgggcgcgcgtgtcccagggggccggctggagcctccgggagaccgcctgcctggggaagtcctacgcccagatgtggcagctgatgtacttccaccgccgggacctccgcctggcggccaacgccatctgcagcgccgtccccgtggactgggtgcccacgagccggaccacctggtccatccacgcccaccaccagtggatgaccacggaggacatgctgagcgtctggaaccgcgtgtggatcgaggagaacccctggatggaggacaagacccacatctccagctgggaggacgtgccgtacctcggcaagcgggaggaccagtggtgcgggtccctgatcggcctgaccgcgcgcgccacctgggccaccaacatccaggtcgccatcaaccaggtgcgccggctcatcggcaacgagaactacctggactacatgacgagcatgaagcgcttcaagaacgagtccgaccccgagggggccctgtggtga

SEQ ID NO: 7921 - RNA, 9879 nt, synthetic construct
  misc_feature 1..9879: note = derived and/or modified CDS sequence (opt1) from DENV-1__HM469966__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatgacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcaccctggccgtgttcttcctgctcatcatggggcagctgacgtggaacgacctgatccgcctctgcatcatggtcggcgcgaacgccagcgaccgcatggggatgggcaccacctacctggccctgatggccaccttcaagatgcggccgatgttcgccgtgggcctcctgttccgccggctgacgtcccgcgaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccggaagtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctgtacggcaacggggtcgtgaccaccagcggcacctacgtgagcgccatcgcccaggccaaggcgtcccaggaggggccgctccccgagatcgaggacgaggtcttccgcaagcggaacctgacgatcatggacctgcaccccggcagcgggaagacccgccggtacctcccggccatcgtgcgcgaggccatcaagcggaagctgcgcaccctgatcctcgcccccacccgcgtggtcgcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgactggatcaccgacttccccggcaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcgtgctcgccggccccatgccggtcacggtggcctccgccgcgcagcgccgggggcgcatcggccggaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccgcctgcggggcgaggcccgcaagaccttcgtggagctcatgcggcgcggggacctgcccgtctggctgtcctacaaggtggccagcgagggcttccagtacagcgaccggcgctggtgcttcgacggcgagcggaacaaccaggtgctcgaggagaacatggacgtcgagatctggacgaaggagggggagcgcaagaagctgcggccccgctggctggacgcccggacctactccgaccccctcgccctgcgcgagttcaaggagttcgcggccggccggcgcagcgtgtccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagacgctgatgctgctcgccctgatcgccgtcctgaccggcggggtgaccctcttcttcctgtccggccgcgggctgggcaagaccagcatcggcctcctgtgcgtgatggcctccagcgtcctgctctggatcgcgtccgtggagccccactggatcgccgccagcatcatcctggagttcttcctgatggtgctcctgatccccgagccggaccggcagcgcacgccccaggacaaccagctggcctacgtcgtgatcgggctcctgttcatgatcctgacggtggccgcgaacgagatgggcctcctggagaccaccaagaaggacctggggatcggccacgtcgccgtggagaaccaccaccacgccgccatcctcgacgtggacctgcaccccgcctccgcgtggaccctgtacgccgtcgccacgaccatcatcaccccgatgatgcggcacaccatcgagaacacgaccgccaacatcagcctcaccgccatcgcgaaccaggccgccatcctgatggggctggacaagggctggcccatctccaagatggacatcggcgtgcccctcctggccctggggtgctacagccaggtgaaccccctcaccctgacggcggccgtcctgatgctcgtggcccactacgccatcatcggcccggggctgcaggccaaggcgacccgcgaggcccagaagcgcaccgccgccggcatcatgaagaaccccaccgtggacgggatcgtcgccatcgacctggaccccgtggtgtacgacgcgaagttcgagaagcagctcggccagatcatgctgctgatcctctgcacgtcccagatcctgctgatgcggaccacctgggccctctgcgagagcatcaccctggccacgggccccctgaccaccctctggaaggggtccccgggcaagttctggaacaccacgatcgccgtcagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgtccaagagcgagttcaacacctacaagcgctccgggatcatggaggtggaccggagcgaggcgaaggagggcctgaagcgcggggagacgaccaagcacgccgtgtcccggggcaccgccaagctccgctggttcgtcgagcggaacctggtgaagcccgaggggaaggtgatcgacctgggctgcggccgcgggggctggagctactactgcgccgggctgaagaaggtcaccgaggtgaagggctacacgaagggcgggcccggccacgaggagcccatcccgatggccacctacgggtggaacctcgtgaagctgtactccggcaaggacgtcttcttcatcccgcccgagaagtgcgacaccctgctctgcgacatcggggagagctcccccaacccgaccatcgaggagggccggacgctgcgcgtgctgaagatggtggagccctggctccgggggaaccagttctgcatcaagatcctgaacccctacatgcccagcgtcgtggagaccctggagcagatgcagcgcaagcacggcggcatgctcgtgcggaacccgctgtcccgcaacagcacccacgagatgtactgggtctcctgcgggaccggcaacatcgtgagcgcggtgaacatgacctcccggatgctgctcaaccgcttcacgatggcccaccgcaagcccacctacgagcgggacgtcgacctgggggccggcacccgccacgtggccgtggagcccgaggtcgccaacctggacatcatcggccagcggatcgagaacatcaagcacgagcacaagagcacctggcactacgacgaggacaacccctacaagacgtgggcgtaccacgggtcctacgaggtgaagccgagcggctccgccagcagcatggtcaacggggtggtgaagctcctgaccaagccctgggacgtcatccccatggtgacccagatcgccatgaccgacacgacccccttcggccagcagcgcgtgttcaaggagaaggtcgacacccggaccccgaaggccaagcgcgggacggcccagatcatggaggtgaccgcgcggtggctgtggggcttcctctcccgcaacaagaagccccggatctgcacccgcgaggagttcacccggaaggtgcgcagcaacgccgccatcggcgccgtcttcgtggacgagaaccagtggaactccgcgaaggaggccgtggaggacgagcggttctgggacctggtccaccgcgagcgggagctgcacaagcaggggaagtgcgccacgtgcgtgtacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttctcccgggagaacagcctgtccggggtggagggcgaggggctgcacaagctcggctacatcctgcgcgacatcagcaagatccccgggggcaacatgtacgccgacgacaccgccggctgggacacccggatcaccgaggacgacctgcagaacgaggccaagatcacggacatcatggagccggagcacgcgctcctggccaaggccatcttcaagctgacctaccagaacaaggtcgtgcgcgtgcagcgccccgccaagaacgggaccgtcatggacgtgatctcccggcgcgaccagcggggcagcggccaggtggggacctacggcctcaacacgttcaccaacatggaggcccagctgatccgccagatggagtccgaggggatcttcagcccctccgagctggagacccccaacctcgcggagcgggtcctggactggctggagaagtacggcgtggagcgcctcaagcggatggccatcagcggggacgactgcgtggtcaagccgatcgacgaccgcttcgccaccgccctgacggccctgaacgacatgggcaaggtgcggaaggacatcccccagtgggagccctccaaggggtggaacgactggcagcaggtccccttctgcagccaccacttccaccagctcatcatgaaggacggccgcgagatcgtcgtgccgtgccggaaccaggacgagctggtgggccgcgcgcgggtctcccagggggccggctggagcctgcgcgagaccgcctgcctcggcaagagctacgcccagatgtggcagctgatgtacttccaccggcgcgacctgcggctcgcggccaacgccatctgctccgccgtgcccgtggactgggtccccaccagccgcaccacgtggtccatccacgcccaccaccagtggatgaccaccgaggacatgctgagcgtgtggaaccgggtgtggatcgaggagaacccctggatggaggacaagacccacatctccagctgggaggacgtcccgtacctgggcaagcgcgaggaccagtggtgcgggtccctcatcggcctgacggcgcgcgccacctgggccaccaacatccaggtggccatcaaccaggtgcggcgcctgatcggcaacgagaactacctcgactacatgaccagcatgaagcggttcaagaacgagtccgaccccgagggggccctgtggtga

SEQ ID NO: 7922 - RNA, 9879 nt, synthetic construct
  misc_feature 1..9879: note = derived and/or modified CDS sequence (opt1) from DENV-1__JX669462__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgagaagcggtccgtggccctggcgccccacgtgggcctggggctcgagacccgcaccgagacctggatgagctccgagggcgcctggcggcagatccagcgcgtcgagacctgggccctgcggcaccccgggttcacggtgatcgccttcttcctggcgcacgccatcggcaccagcatcacccagaaggggatcatcttcatcctcctgatgctggtgaccccctccatggccatgcgctgcgtcggcatcggcaaccgggacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcgcaagctctgcatcgaggccaagatcagcaacaccaccacggactcccggtgcccgacccagggcgaggccaccctggtggaggagcaggacgccaacttcgtctgccgccggaccttcgtggaccgcggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccgccaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccggctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctgatcacggccaacccgatcgtcaccgacaaggagaagcccgtgaacatcgagaccgagccgcccttcggggagagctacatcgtggtcggcgccggcgagaaggcgctcaagctgtcctggttcaagcgggggagctccatcggcaagatgttcgaggccaccgcccgcggggcccgccggatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcgcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcgtgttcaccacgaacatctggctgaagctgcgggactcctacacccagatgtgcgaccaccgcctcatgagcgcggccatcaaggactccaaggccgtgcacgccgacatgggctactggatcgagagcgagaagaacgagacctggaagctggcccgggcgtccttcatcgaggtcaagacctgcacgtggcccaagagccacaccctgtggtccaacggggtgctcgagagcgagatgatcatccccaagatcttcggcgggccgatctcccagcacaactaccgccccggctacttcacccagaccgccgggccctggcacctgggcaagctggagctcgacttcgacctgtgcgagggcacgaccgtggtcgtggacgagcactgcgggaaccggggcccgagcctgcgcaccaccacggtgaccgggaagatcatccacgagtggtgctgccggtcctgcaccctgccgcccctgcgcttccggggcgaggacgggtgctggtacggcatggagatccgccccgtcaaggagaaggaggagaacctggtgcggagcatggtgtccgccggcagcggggaggtcgacagcttctccctcggcatcctgtgcgtgagcatcatgatcgaggaggtgatgcgctcccgctggagccggaagatgctgatgaccgggacgctcgccgtcttcctgctgctcatcatgggccagctgacctggaacgacctgatccgcctctgcatcatggtgggggccaacgcgtccgaccggatgggcatgggcaccacctacctggccctgatggccacgctcaagatgcgcccgatgttcgccgtggggctgctgttccggcgcctcaccagccgggaggtcctgctgctcaccatcggcctgtccctggtggccagcgtcgagctccccaactccctggaggagctgggggacggcctcgcgatgggcatcatgatgctgaagctgctcaccgagttccagccccaccagctgtggacgaccctgctcagcctgaccttcgtgaagaccacgctgtccctcgactacgcctggaagaccaccgccatggtgctgagcatcgtctccctgttccccctctgcctgagcaccacgtcccagaagaccacctggctgccggtgctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtccccctcgcgggcccgctgatcgccggcgggatgctgatcgcctgctacgtgatcagcggctccagcgccgacctctccctggagaaggccgcggaggtgagctgggagcaggaggccgagcactccggggccagccacaacatcctggtcgaggtgcaggacgacggcacgatgaagatcaaggacgaggagcgggacgacaccctcaccatcctgctgaaggccaccctcctggccgtgtccggggtctaccccatgagcatccccgcgacgctgttcgtgtggtacttctggcagaagaagaagcagcgctccggcgtgctctgggacacccccagcccgcccgaggtcgagcgggccgtgctggacgacggcatctaccgcatcctgcagcgggggctgctcggccgctcccaggtgggggtcggcgtgttccaggacggggtgttccacaccatgtggcacgtcacccggggcgccgtgctgatgtaccagggcaagcgcctggagcccagctgggcctccgtgaagaaggacctcatcagctacgggggcgggtggcggttccagggctcctggaacacgggggaggaggtccaggtgatcgccgtggagcccggcaagaacccgaagaacgtccagaccacccccggcaccttcaagacgcccgagggggaggtgggcgcgatcgccctggacttcaagcccgggaccagcggctccccgatcgtgaaccgcgagggcaagatcgtcgggctgtacggcaacggggtggtgaccaccagcggcacgtacgtctccgccatcgcccaggccaaggcgagccaggaggggcccctccccgagatcgaggacgaggtgttcaagaagcggaacctgaccatcatggacctgcacccgggcagcggcaagacccgccggtacctccccgccatcgtgcgcgaggccatcaagcgcaagctgcggaccctgatcctcgcccccacgcgcgtcgtggcgtccgagatggccgaggccctgaaggggatgcccatccggtaccagaccaccgccgtcaagagcgagcacaccggccgcgagatcgtcgacctgatgtgccacgccacgttcaccatgcggctcctgtccccggtgcgcgtgcccaactacaacatgatcatcatggacgaggcgcacttcaccgaccccgccagcatcgccgcccgggggtacatctccacccgcgtcggcatgggggaggccgcggccatcttcatgacggccacgccgcccggcagcgtggaggccttcccccagtccaacgccgtgatccaggacgaggagcgggacatccccgagcgcagctggaactccggctacgactggatcaccgacttccccgggaagaccgtctggttcgtgcccagcatcaagtccggcaacgacatcgcgaactgcctgcggaagaacgggaagcgcgtgatccagctcagccggaagacgttcgacaccgagtaccagaagaccaagaacaacgactgggactacgtcgtgaccacggacatctccgagatgggcgccaacttccgcgccgaccgggtgatcgacccccgccggtgcctgaagcccgtcatcctgaaggacgggcccgagcgcgtgatcctcgccggcccgatgcccgtcaccgtggcgagcgccgcccagcggcgcggccgcatcgggcggaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagacgttcgtcgagctcatgcgccggggcgacctgcccgtgtggctgagctacaaggtggcctccgaggggttccagtacagcgaccgccggtggtgcttcgacggcgagcgcaacaaccaggtcctcgaggagaacatggacgtggagatctggaccaaggagggggagcggaagaagctgcgcccccggtggctggacgcgcgcacctactccgacccgctcgccctgcgggagttcaaggagttcgccgccggccgccggagcgtgagcggcgacctgatcctcgagatcgggaagctgccccagcacctgaccctccgcgcccagaacgcgctggacaacctggtcatgctccacaactccgagcagggcgggaaggcctaccggcacgccatggaggagctgcccgacaccatcgagacgctgatgctcctggccctgatcgcggtgctcaccggcggggtgaccctgttcttcctgagcggcaagggcctcgggaagacctccatcggcctgctgtgcgtcacggccagctccgccctcctgtggatggccagcgtggagccccactggatcgccgcgtccatcatcctggagttcttcctcatggtgctgctgatcccggagcccgaccgccagcggacgccccaggacaaccagctcgcctacgtcgtgatcgggctgctgttcatgatcctcaccgtggccgccaacgagatgggcctgctggagaccacgaagaaggacctcgggatcggctacgtcgccgcggagaaccaccagcacgccaccatgctggacgtggacctgcacccggccagcgcctggaccctctacgccgtggcgaccacggtcatcacccccatgatgcgccacaccatcgagaacaccacggccaacatctccctgaccgccatcgccaaccaggccgcgatcctgatgggcctcgacaaggggtggcccatcagcaagatggacatcggcgtgcccctgctggccctcgggtgctactcccaggtgaacccgctgaccctgaccgccgccgtcctcatgctggtggcgcactacgccatcatcggccccgggctgcaggccaaggccacgcgcgaggcccagaagcggaccgcggccggcatcatgaagaaccccaccgtggacggcatcgtcgccatcgacctcgaccccgtggtgtacgacgccaagttcgagaagcagctggggcagatcatgctgctcatcctgtgcaccagccagatcctgctcatgcgcacgacctgggccctgtgcgagtccatcaccctggcgaccggcccgctcacgaccctgtgggaggggagccccggcaagttctggaacaccaccatcgccgtctccatggccaacatcttccggggcagctacctggccggggccggcctcgcgttctccctgatgaagtccctcgggggcgggcgccgggggacgggcgcccagggggagaccctcggcgagaagtggaagcgccagctgaaccagctgtccaagagcgagttcaacacctacaagcggagcgggatcatggaggtggaccgctccgaggccaaggagggcctcaagcgcggggagaccacgaagcacgccgtgagccgcggcaccgcgaagctgcggtggttcgtcgagcgcaacctggtgaagcccgagggcaaggtgatcgacctggggtgcggccgcgggggctggtcctactactgcgccgggctcaagaaggtcaccgaggtgaagggctacaccaagggcgggcccggccacgaggagccgatccccatggccacctacgggtggaacctggtgaagctgcacagcggcaaggacgtcttcttcatgccgcccgagaagtgcgacacgctcctgtgcgacatcggggagtccagcccgaaccccaccatcgaggagggccgcaccctgcgggtgctcaagatggtggagccctggctgcgcggcaaccagttctgcatcaagatcctgaacccctacatgccgtccgtcgtggagaccctcgagcagatgcagcggaagcacgggggcatgctggtgcgcaaccccctgagccggaactccacgcacgagatgtactgggtcagctgcgggaccggcaacatcgtgtccgccgtgaacatgaccagccgcatgctcctgaaccgcttcaccatggcccaccggaagcccacgtacgagcgcgacgtcgacctgggcgcggggacccggcacgtggccgtggagcccgaggtcgccaacctcgacatcatcggccagcgcatcgagaacatcaagaacgagcacaagtccacctggcactacgacgaggacaacccgtacaagacctgggcctaccacgggagctacgaggtgaagccctccggcagcgcctccagcatggtcaacggggtggtgcggctgctgacgaagccctgggacgtcatccccatggtgacccagatcgcgatgaccgacaccacgccgttcggccagcagcgcgtgttcaaggagaaggtcgacacccggacgccccgggccaagcggggcaccacgcagatcatggaggtgaccgccaagtggctctgggggttcctgtcccgcaacaagaagccccggatctgcacccgcgaggagttcacccggaaggtgcgcagcaacgccgccatcggcgcggtcttcgtggacgagaaccagtggaacagcgccaaggaggccgtggaggacgagcggttctgggacctggtccaccgcgagcgggagctccacaagcaggggaagtgcgccacgtgcgtgtacaacatgatgggcaagcgcgagaagaagctgggggagttcggcaaggcgaagggctcccgggccatctggtacatgtggctgggggcccgcttcctcgagttcgaggccctgggcttcatgaacgaggaccactggttcagccgggagaactccctgagcggggtggagggcgaggggctccacaagctgggctacatcctgcgcgacatctccaagatcccgggcgggaacatgtacgccgacgacaccgcgggctgggacacccgcatcaccgaggacgacctccagaacgaggccaagatcacggacatcatggagcccgagcacgccctgctggccaccagcatcttcaagctcacctaccagaacaaggtcgtgcgggtgcagcgccccgccaagaacgggaccgtcatggacgtgatctcccggcgcgaccagcggggcagcggccaggtggggacgtacggcctgaacaccttcaccaacatggaggtccagctgatccgccagatggagtccgaggggatcttcctccccagcgagctggagaccccgaacctggcggagcgggccctcgactggctggagaagcacggcgccgagcgcctgaagcggatggccatctccggggacgactgcgtggtgaagcccatcgacgaccgcttcgccacggcgctcaccgccctgaacgacatgggcaaggtccggaaggacatcccccagtgggagcccagcaagggctggaacgactggcagcaggtcccgttctgctcccaccacttccaccagctgatcatgaaggacgggcgcgagatcgtggtcccctgccggaaccaggacgagctcgtgggccgcgcccgggtgagccagggggccggctggtccctgcgcgagaccgcctgcctgggcaagagctacgcgcagatgtggcagctcatgtacttccaccggcgcgacctgcggctggccgccaacgccatctgctccgcggtccccgtggactgggtgcccgccagccgcaccacctggagcatccacgcccaccaccagtggatgacgaccgaggacatgctctccgtctggaaccgcgtgtggatcgaggagaacccgtggatggaggacaagacccacgtgagctcctgggaggaggtcccctacctgggcaagcgggaggaccagtggtgcggcagcctgatcgggctcaccgcccgcgccacgtgggcgaccaacatccaggtggccatcaaccaggtgcggcgcctgatcggcaacgagaactacctggactacatgacctccatgaagcggttcaagaacgagagcgaccccgagggggccctctggtga

SEQ ID NO: 7923 - RNA, 9879 nt, synthetic construct
  misc_feature 1..9879: note = derived and/or modified CDS sequence (opt1) from DENV-1__JX669463__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgcgagaagcggtccgtggccctggcgccccacgtgggcctggggctcgagacccgcaccgagacctggatgagctccgagggcgcctggcggcagatccagcgcgtcgagacctgggccctgcggcaccccgggttcacggtgatcgccttcttcctggcgcacgccatcggcaccagcatcacccagaaggggatcatcttcatcctcctgatgctggtgaccccctccatggccatgcgctgcgtcggcatcggcaaccgggacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcgcaagctctgcatcgaggccaagatcagcaacaccaccacggactcccggtgcccgacccagggcgaggccaccctggtggaggagcaggacgccaacttcgtctgccgccggaccttcgtggaccgcggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccgccaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccggctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctgatcacggccaacccgatcgtcaccgacaaggagaagcccgtgaacatcgagaccgagccgcccttcggggagagctacatcgtggtcggcgccggcgagaaggcgctcaagctgtcctggttcaagcgggggagctccatcggcaagatgttcgaggccaccgcccgcggggcccgccggatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcgcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcgtgttcaccacgaacatctggctgaagctgcgggactcctacacccagatgtgcgaccaccgcctcatgagcgcggccatcaaggactccaaggccgtgcacgccgacatgggctactggatcgagagcgagaagaacgagacctggaagctggcccgggcgtccttcatcgaggtcaagacctgcacgtggcccaagagccacaccctgtggtccaacggggtgctcgagagcgagatgatcatccccaagatcttcggcgggccgatctcccagcacaactaccgccccggctacttcacccagaccgccgggccctggcacctgggcaagctggagctcgacttcgacctgtgcgagggcacgaccgtggtcgtggacgagcactgcgggaaccggggcccgagcctgcgcaccaccacggtgaccgggaagatcatccacgagtggtgctgccggtcctgcaccctgccgcccctgcgcttccggggcgaggacgggtgctggtacggcatggagatccgccccgtcaaggagaaggaggagaacctggtgcggagcatggtgtccgccggcagcggggaggtcgacagcttctccctcggcatcctgtgcgtgagcatcatgatcgaggaggtgatgcgctcccgctggagccggaagatgctgatgaccgggacgctcgccgtcttcctgctgctcatcatgggccagctgacctggaacgacctgatccgcctctgcatcatggtgggggccaacgcgtccgaccggatgggcatgggcaccacctacctggccctgatggccacgctcaagatgcgcccgatgttcgccgtggggctgctgttccggcgcctcaccagccgggaggtcctgctgctcaccatcggcctgtccctggtggccagcgtcgagctccccaactccctggaggagctgggggacggcctcgcgatgggcatcatgatgctgaagctgctcaccgagttccagccccaccagctgtggacgaccctgctcagcctgaccttcgtgaagaccacgctgtccctcgactacgcctggaagaccaccgccatggtgctgagcatcgtctccctgttccccctctgcctgagcaccacgtcccagaagaccacctggctgccggtgctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtccccctcgcgggcccgctgatcgccggcgggatgctgatcgcctgctacgtgatcagcggctccagcgccgacctctccctggagaaggccgcggaggtgagctgggagcaggaggccgagcactccggggccagccacaacatcctggtcgaggtgcaggacgacggcacgatgaagatcaaggacgaggagcgggacgacaccctcaccatcctgctgaaggccaccctcctggccgtgtccggggtctaccccatgagcatccccgcgacgctgttcgtgtggtacttctggcagaagaagaagcagcgctccggcgtgctctgggacacccccagcccgcccgaggtcgagcgggccgtgctggacgacggcatctaccgcatcctgcagcgggggctgctcggccgctcccaggtgggggtcggcgtgttccaggacggggtgttccacaccatgtggcacgtcacccggggcgccgtgctgatgtaccagggcaagcgcctggagcccagctgggcctccgtgaagaaggacctcatcagctacgggggcgggtggcggttccagggctcctggaacacgggggaggaggtccaggtgatcgccgtggagcccggcaagaacccgaagaacgtccagaccacccccggcaccttcaagacgcccgagggggaggtgggcgcgatcgccctggacttcaagcccgggaccagcggctccccgatcgtgaaccgcgagggcaagatcgtcgggctgtacggcaacggggtggtgaccaccagcggcacgtacgtctccgccatcgcccaggccaaggcgagccaggaggggcccctccccgagatcgaggacgaggtgttcaagaagcggaacctgaccatcatggacctgcacccgggcagcggcaagacccgccggtacctccccgccatcgtgcgcgaggccatcaagcgcaagctgcggaccctgatcctcgcccccacgcgcgtcgtggcgtccgagatggccgaggccctgaaggggatgcccatccggtaccagaccaccgccgtcaagagcgagcacaccggccgcgagatcgtcgacctgatgtgccacgccacgttcaccatgcggctcctgtccccggtgcgcgtgcccaactacaacatgatcatcatggacgaggcgcacttcaccgaccccgccagcatcgccgcccgggggtacatctccacccgcgtcggcatgggggaggccgcggccatcttcatgacggccacgccgcccggcagcgtggaggccttcccccagtccaacgccgtgatccaggacgaggagcgggacatccccgagcgcagctggaactccggctacgactggatcaccgacttccccgggaagaccgtctggttcgtgcccagcatcaagtccggcaacgacatcgcgaactgcctgcggaagaacgggaagcgcgtgatccagctcagccggaagacgttcgacaccgagtaccagaagaccaagaacaacgactgggactacgtcgtgaccacggacatctccgagatgggcgccaacttccgcgccgaccgggtgatcgacccccgccggtgcctgaagcccgtcatcctgaaggacgggcccgagcgcgtgatcctcgccggcccgatgcccgtcaccgtggcgagcgccgcccagcggcgcggccgcatcgggcggaaccagaacaaggagggcgaccagtacatctacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagacgttcgtggagctcatgcgccggggcgacctgcccgtctggctgagctacaaggtggcctccgaggggttccagtacagcgaccgccggtggtgcttcgacggcgagcgcaacaaccaggtgctcgaggagaacatggacgtcgagatctggaccaaggagggggagcggaagaagctgcgcccccggtggctggacgcgcgcacctactccgacccgctcgccctgcgggagttcaaggagttcgccgccggccgccggagcgtgagcggcgacctgatcctcgagatcgggaagctgccccagcacctgaccctccgcgcccagaacgcgctggacaacctggtgatgctccacaactccgagcagggcgggaaggcctaccggcacgccatggaggagctgcccgacaccatcgagacgctgatgctcctggccctgatcgcggtcctcaccggcggggtgaccctgttcttcctgagcggcaagggcctcgggaagacctccatcggcctgctgtgcgtgacggccagctccgccctcctgtggatggccagcgtcgagccccactggatcgccgcgtccatcatcctggagttcttcctcatggtgctgctgatcccggagcccgaccgccagcggacgccccaggacaaccagctcgcctacgtggtcatcgggctgctgttcatgatcctcaccgtggccgccaacgagatgggcctgctggagaccacgaagaaggacctcgggatcggctacgtggccgcggagaaccaccagcacgccaccatgctggacgtcgacctgcacccggccagcgcctggaccctctacgccgtggcgaccacggtgatcacccccatgatgcgccacaccatcgagaacaccacggccaacatctccctgaccgccatcgccaaccaggccgcgatcctgatgggcctcgacaaggggtggcccatcagcaagatggacatcggcgtccccctgctggccctcgggtgctactcccaggtgaacccgctgaccctgaccgccgccgtgctcatgctggtcgcgcactacgccatcatcggccccgggctgcaggccaaggccacgcgcgaggcccagaagcggaccgcggccggcatcatgaagaaccccaccgtggacggcatcgtggccatcgacctcgaccccgtcgtgtacgacgccaagttcgagaagcagctggggcagatcatgctgctcatcctgtgcaccagccagatcctgctcatgcgcacgacctgggccctgtgcgagtccatcaccctggcgaccggcccgctcacgaccctgtgggaggggagccccggcaagttctggaacaccaccatcgccgtgtccatggccaacatcttccggggcagctacctggccggggccggcctcgcgttctccctgatgaagtccctcgggggcgggcgccgggggacgggcgcccagggggagaccctcggcgagaagtggaagcgccagctgaaccagctgtccaagagcgagttcaacacctacaagcggagcgggatcatggaggtcgaccgctccgaggccaaggagggcctcaagcgcggggagaccacgaagcacgccgtgagccgcggcaccgcgaagctgcggtggttcgtggagcgcaacctggtcaagcccgagggcaaggtgatcgacctggggtgcggccgcgggggctggtcctactactgcgccgggctcaagaaggtgaccgaggtcaagggctacaccaagggcgggcccggccacgaggagccgatccccatggccacctacgggtggaacctggtgaagctgcacagcggcaaggacgtgttcttcatgccgcccgagaagtgcgacacgctcctgtgcgacatcggggagtccagcccgaaccccaccatcgaggagggccgcaccctgcgggtcctcaagatggtggagccctggctgcgcggcaaccagttctgcatcaagatcctgaacccctacatgccgtccgtggtcgagaccctcgagcagatgcagcggaagcacgggggcatgctggtgcgcaaccccctgagccggaactccacgcacgagatgtactgggtgagctgcgggaccggcaacatcgtctccgccgtgaacatgaccagccgcatgctcctgaaccgcttcaccatggcccaccggaagcccacgtacgagcgcgacgtggacctgggcgcggggacccggcacgtcgccgtggagcccgaggtggccaacctcgacatcatcggccagcgcatcgagaacatcaagaacgagcacaagtccacctggcactacgacgaggacaacccgtacaagacctgggcctaccacgggagctacgaggtcaagccctccggcagcgcctccagcatggtgaacggggtcgtgcggctgctgacgaagccctgggacgtgatccccatggtcacccagatcgcgatgaccgacaccacgccgttcggccagcagcgcgtgttcaaggagaaggtggacacccggacgccccgggccaagcggggcaccacgcagatcatggaggtcaccgccaagtggctctgggggttcctgtcccgcaacaagaagccccggatctgcacccgcgaggagttcacccggaaggtgcgcagcaacgccgccatcggcgcggtgttcgtcgacgagaaccagtggaacagcgccaaggaggccgtggaggacgagcggttctgggacctggtgcaccgcgagcgggagctccacaagcaggggaagtgcgccacgtgcgtctacaacatgatgggcaagcgcgagaagaagctgggggagttcggcaaggcgaagggctcccgggccatctggtacatgtggctgggggcccgcttcctcgagttcgaggccctgggcttcatgaacgaggaccactggttcagccgggagaactccctgagcggggtggagggcgaggggctccacaagctgggctacatcctgcgcgacatctccaagatcccgggcgggaacatgtacgccgacgacaccgcgggctgggacacccgcatcaccgaggacgacctccagaacgaggccaagatcacggacatcatggagcccgagcacgccctgctggccaccagcatcttcaagctcacctaccagaacaaggtggtccgggtgcagcgccccgccaagaacgggaccgtgatggacgtcatctcccggcgcgaccagcggggcagcggccaggtggggacgtacggcctgaacaccttcaccaacatggaggtgcagctgatccgccagatggagtccgaggggatcttcctccccagcgagctggagaccccgaacctggcggagcgggccctcgactggctggagaagcacggcgccgagcgcctgaagcggatggccatctccggggacgactgcgtcgtgaagcccatcgacgaccgcttcgccacggcgctcaccgccctgaacgacatgggcaaggtgcggaaggacatcccccagtgggagcccagcaagggctggaacgactggcagcaggtcccgttctgctcccaccacttccaccagctgatcatgaaggacgggcgcgagatcgtggtgccctgccggaaccaggacgagctcgtcggccgcgcccgggtgagccagggggccggctggtccctgcgcgagaccgcctgcctgggcaagagctacgcgcagatgtggcagctcatgtacttccaccggcgcgacctgcggctggccgccaacgccatctgctccgcggtgcccgtcgactgggtgcccgccagccgcaccacctggagcatccacgcccaccaccagtggatgacgaccgaggacatgctctccgtgtggaaccgcgtctggatcgaggagaacccgtggatggaggacaagacccacgtgagctcctgggaggaggtgccctacctgggcaagcgggaggaccagtggtgcggcagcctgatcgggctcaccgcccgcgccacgtgggcgaccaacatccaggtcgccatcaaccaggtgcggcgcctgatcggcaacgagaactacctggactacatgacctccatgaagcggttcaagaacgagagcgaccccgagggggccctctggtga

SEQ ID NO: 7924 - RNA, 9879 nt, synthetic construct
  misc_feature 1..9879: note = derived and/or modified CDS sequence (opt1) from DENV-1__JX669464__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgtgggggtgaacatgtgcaccctgatcgcgatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacccgcaccgagacctggatgagctccgagggcgcgtggaagcagatccagaaggtggagacctgggccctgcggcaccccgggttcacggtgatcgccctgttcctcgcccacgcgatcggcaccagcatcacccagaaggggatcatcttcatcctgctgatgctcgtcaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgcccgacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttcctcacccaggacgagaagggggtcacccagaacggccgcctgatcacggccaacccgatcgtgaccgacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcccgccggatggccatcctgggcgacacggcctgggacttcgggtccatcggcggcctgttcaccagcgtggggaagctcatccaccaggtcttcggcaccgcgtacggggtgctgttctccggcgtgagctggaccatgaagatcgggatcggcatcctgctcacgtggctgggcctgaactcccgcagcacctccctcagcatgacctgcatcgccgtcgggatggtgaccctgtacctgggcgtgatggtccaggccgactccgggtgcgtgatcaactggaagggccgcgagctcaagtgcgggagcggcatcttcgtgacgaacgaggtccacacctggaccgagcagtacaagttccaggccgactccccgaagcggctgagcgccgcgatcggcaaggcctgggaggagggggtgtgcggcatccgcagcgccacccggctggagaacatcatgtggaagcagatctccaacgagctcaactacatcctgctggagaacgacatgaagttcaccgtggtcgtgggggacgtgaacggcatcctcgcccaggggaagaagatgatccgcccccagcccatggagcacaagtacagctggaagtcctggggcaaggccaagatcatcggcgcggacatccagaacacgaccttcatcatcgacgggcccgacaccccggagtgccccgacgaccagcgggcctggaacatctgggaggtcgaggactacggcttcgggatcttcaccacgaacatctggctgaagctgcgcgacagccacacccagatgtgcgaccaccggctcatgtccgccgccatcaaggacagcaaggcggtgcacgccgacatgggctactggatcgagtccgagaagaacgagacctggaagctggcccgcgccagcttcatcgaggtgaagacctgcatctggcccaagtcccacacgctgtggagcaacggcgtcctcgagtccgagatggtgatccccaagatctacgggggcccgatcagccagcacaactaccggcccgggtacttcacccagaccgccggcccctggcacctggggaagctggagctcgacttcgacctgtgcgagggcaccacggtggtcgtggacgagcactgcggctaccgcgggccgtccctgcggaccaccaccgtgacgggcaagatcatccacgagtggtgctgccgcagctgcaccctgccgcccctgcggttccgcggggaggacggctgctggtacgggatggagatccggcccgtcaaggagaaggaggagaacctggtgcgctccatggtgagcgcgggctccggcgagatggacagcttcagcctcgggatcctgtgcgtctccatcctgatcgaggaggtgatgcggagccgctggtcccggaagatgctcatgaccggcaccctggccgtgttcctgctcctgatcatggggcagctgacgtggaacgacctcatccgcctgtgcatcatggtcggcgccaacgccagcgaccgcatggggatgggcaccacctacctggccctcatggccaccttcaagatgcggccgatgttcgccgtggggctgctgttccgccggctcacgtcccgcgaggtgctgctgctcaccgtcgggctgagcctggtggcctccgtcgagctccccaacagcctggaggagctgggcgacgggctcgccatgggcatcatgatgctgaagctgctcaccgacttccagccccaccagctgtggaccacgctgctctccctgaccttcatccggaccagcctgtccctcgactacgcctggaagaccatggcgatggccctgagcatcgtgtccctgttccccctctgcctgagcacgacctcccagaagaccacctggctgccggtgctcctgggcagcttcgggtgcaagcccctgacgatgttcctcatcaccgagaacaagatctggggccgcaagtcctggcccatcaacgaggggatcatggccgtcggcatcgtgagcatcctgctgtccagcctcctgaagaacgacgtgcccctggccgggccgctcatcgcgggcggcatgctgatcgcctgctacgtcatcagcgggtccagcgccgacctgtccctcgagaaggccgccgaggtgagctgggaggaggaggcggagcactccggcaccagccacaacatcctggtggaggtccaggacgacgggaccatgaagatcaaggacgaggagcgggacgacaccctgacgatcctcctgaaggccaccctgctcgccgtgtccggcgtgtaccccatgagcatccccgccaccctgttcgtctggtacttctggcagaagaagaagcagcgctccggggtgctgtgggacacccccagcccgcccgaggtggagcgggccgtcctggacgacggcatctaccgcatcctccagcggggcctgctggggcgctcccaggtgggcgtgggggtcttccaggacggcgtgttccacacgatgtggcacgtgacccgcggggcggtcctcatgtaccagggcaagcgcctggagcccagctgggcctccgtgaagaaggacctgatcagctacggcgggggctggcggttccaggggtcctggaacaccggcgaggaggtgcaggtcatcgccgtggagcccgggaagaacccgaagaacgtgcagaccacgcccggcaccttcaagatccccgagggcgaggtcggggccatcgccctcgacttcaagcccggcaccagcgggtccccgatcgtgaaccgcgagggcaagatcgtgggcctgtacgggaacggcgtcgtgaccacgagcgggacctacgtgtccgcgatcgcccaggccaaggccacccaggagggccccctgcccgagatcgaggacgaggtcttcaagaagcggaacctcaccatcatggacctgcacccggggagcggcaagacgcgccggtacctgcccgccatcgtgcgcgaggcgatcaagcggaagctccgcaccctgatcctggcccccacccgcgtggtcgccagcgagatggccgaggcgctcaagggcatgcccatccggtaccagaccacggccgtgaagtccgagcacaccgggcgcgagatcgtggacctgatgtgccacgccaccttcaccatgcggctgctcagcccggtccgcgtgcccaactacaacatgatcatcatggacgaggcccacttcacggaccccgcctccatcgcggcccggggctacatcagcacccgcgtggggatgggcgaggccgccgccatcttcatgaccgcgacgccgcccgggtccgtcgaggccttcccccagagcaacgccgtgatccaggacgaggagcgggacatccccgagcgctcctggaacagcggctacgactggatcacggacttccccggcaagaccgtgtggttcgtcccctccatcaagagcgggaacgacatcgccaactgcctgcggaagaacggcaagcgcgtgatccagctgtcccggaagaccttcgacaccgagtaccagaagacgaagaacaacgactgggactacgtggtcaccaccgacatcagcgagatgggggccaacttccgcgcggaccgggtgatcgacccccgccggtgcctcaagcccgtgatcctgaaggagggccccgagcgcgtcatcctggccgggccgatgcccgtgaccgtcgcctccgccgcgcagcggcgcggccggatcggccgcaaccagaacaaggagggggaccagtacatctacatgggccagcccctcaacaacgacgaggaccacgcccactggacggaggccaagatgctgctggacaacatcaacacccccgaggggatcatcccggccctcttcgagcccgagcgcgagaagtccgccgcgatcgacggcgagtaccggctgcgcggggaggcccggaagaccttcgtggagctgatgcgccggggcgacctccccgtgtggctgtcctacaaggtcgccagcgagggcttccagtactccgaccgccggtggtgcttcgacggggagcgcaacaaccaggtgctggaggagaacatggacgtggagatctggaccaaggagggcgagcggaagaagctccgcccccggtggctggacgcccgcacgtacagcgacccgctggccctccgggagttcaaggagttcgcggccgggcgccggtccgtcagcggcgacctgatcctggagatcggcaagctcccccagcacctgaccctgcgcgcccagaacgccctcgacaacctggtgatgctgcacaacagcgagcagggcgggaaggcctaccggcacgcgatggaggagctccccgacaccatcgagaccctgatgctgctcgccctgatcgccgtgctgaccgggggcgtcaccctcttcttcctgtccgggaagggcctgggcaagaccagcatcgggctcctgtgcgtgatggcctccagcgcgctgctctggatggcctccgtggagccccactggatcgccgccagcatcatcctggagttcttcctgatggtcctcctgatcccggagcccgaccgccagcggacgccccaggacaaccagctggcctacgtggtgatcggcctcctgttcatgatcctgaccgtcgcggccaacgagatggggctcctggagacgaccaagaaggacctgggcatcgggcacgtggccgtggagaaccaccaccacgccaccatgctcgacgtcgacctgcgcccggcctccgcgtggaccctgtacgccgtggccacgaccgtgatcacccccatgatgcggcacaccatcgagaacacgaccgccaacatcagcctcaccgccatcgcgaaccaggccgccatcctgatgggcctggacaagggctggcccatctccaagatggacatcggggtccccctcctggccctgggctgctacagccaggtgaacccgctcaccctgacggccgcggtgctgatgctcgtcgcccactacgccatcatcgggcccggcctgcaggccaaggcgacccgcgaggcccagaagcgcaccgccgccgggatcatgaagaaccccaccgtggacggcatcgtgacgatcgacctggaccccgtcgtgtacgacgccaagttcgagaagcagctcggccagatcatgctgctgatcctctgcacctcccagatcctgctgatgcggaccacctgggcgctctgcgagagcatcacgctggccaccgggccgctgaccaccctctgggagggctcccccgggaagttctggaacacgaccatcgccgtgagcatggccaacatcttccgcggctcctacctggccggcgcggggctggccttcagcctcatgaagtccctgggcgggggccggcgcgggaccggcgcccagggcgagaccctgggggagaagtggaagcggcagctcaaccagctgagcaagtccgagttcaacacgtacaagaagtccggcatcatggaggtcgaccgcagcgaggccaaggaggggctgaagcggggcgagaccaccaagcacgccgtgtcccgcgggaccgcgaagctgcggtggttcgtggagcgcaacctcgtcaagcccgagggcaaggtgatcgacctgggctgcgggcggggcgggtggagctactactgcgccggcctgaagaaggtgacggaggtcaaggggtacaccaagggcggccccgggcacgaggagccgatccccatggccacctacggctggaacctcgtgaagctgcactccgggaaggacgtgttcttcacgccgcccgagaagtgcgacaccctgctctgcgacatcggcgagagctccccgaaccccacgatcgaggaggggcgcaccctgcgggtcctgaagatggtggagccctggctccgcggcaaccagttctgcatcaagatcctgaacccctacatgccgagcgtggtcgagaccctggagcagatgcagcggaagcacggcgggatgctcgtgcgcaaccccctgtcccggaacagcacccacgagatgtactgggtgtcctgcggcacggggaacatcgtcagcgccgtgaacatgacctcccgcatgctgctcaaccggttcaccatggcgcaccgcaagcccacctacgagcgcgacgtggacctgggcgccggcacgcggcacgtcgccgtggagcccgaggtggccaacctggacatcatcgggcagcgcatcgagaacatcaagaacgagcacaagagcacctggcactacgacgaggacaacccgtacaagacctgggcctaccacggctcctacgaggtcaagcccagcgggtccgcgagctccatggtgaacggcgtcgtgcggctcctgaccaagccctgggacgtgatccccatggtcacgcagatcgccatgaccgacaccaccccgttcgggcagcagcgcgtgttcaaggagaaggtggacacgcggacgccccgggccaagcggggcaccgcccagatcatggaggtcaccgccaagtggctgtggggcttcctcagccgcaacaagaagccccggatctgcacgcgcgaggagttcacccggaaggtgcgctccaacgcggccatcggggccgtgttcgtcgacgagaaccagtggaacagcgccaaggaggccgtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaagatcccgggcggcaacatgtacgccgacgacaccgccgggtgggacacgcggatcaccgaggacgacctgcagaacgaggccaagatcaccgacatcatggagcccgagcacgccctcctggcgacctccatcttcaagctgacgtaccagaacaaggtggtccgcgtgcagcgccccgccaagagcggcaccgtgatggacgtcatctcccggcgcgaccagcgggggagcggccaggtgggcacctacgggctcaacaccttcacgaacatggaggtgcagctgatccgccagatggagtccgagggcatcttcctgcccagcgagctcgagaccccgaacctggccaagaaggtcctggactggctcgagaagcacggggccgagcggctgaagcgcatggccatctccggcgacgactgcgtggtgaagcccatcgacgaccggttcgcgaccgccctgaccgccctcaacgacatggggaaggtccgcaaggacatcccccagtgggagcccagcaagggctggaacgactggcagcaggtcccgttctgctcccaccacttccaccagctgatcatgaaggacggccgggagatcgtggtcccctgccgcaaccaggacgagctggtggggcgggcccgcgtgagccagggcgccgggtggtccctccgggagacggcgtgcctgggcaagagctacgcccagatgtggcagctgatgtacttccaccgccgggacctccgcctggccgccaacgccatctgctccgcggtccccgtggactgggtgcccaccagccggaccacctggagcatccacgcccaccaccagtggatgaccacggaggacatgctgtccgtctggaaccgcgtgtggatcgaggagaacccgtggatggaggacaagacccacgtgagctcctgggaggaggtcccctacctcgggaagcgggaggaccagtggtgcggcagcctgatcggcctgaccgcccgcgccacctgggcgacgaacatccaggtggccatcaaccaggtgcgccggctcatcgggaacgagaactacctggactacatgacctccatgaagcgcttcaagaacgagagcgaccccgagggcgccctgtggtga

SEQ ID NO: 7925 - RNA, 9879 nt, synthetic construct
  misc_feature 1..9879: note = derived and/or modified CDS sequence (opt1) from DENV-1__JX669465__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgtgggggtgaacatgtgcaccctgatcgcgatggacctgggcgagctctgcgaggacaccatgacctacaagtgcccccggatcaccgaggccgagcccgacgacgtcgactgctggtgcaacgccaccgacacctgggtgacctacgggacctgcagccagaccggcgagcaccggcgcgacaagcggtccgtggccctggcgccccacgtcggcctggggctcgagacgcgcaccgagacctggatgagctccgagggcgcgtggaagcagatccagaaggtggagacctgggccctgcggcaccccgggttcaccgtgatcgccctgttcctcgcccacgcgatcggcaccagcatcacccagaaggggatcatcttcatcctgctgatgctcgtcaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgcccgacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttcctcacccaggacgagaagggggtcacccagaacggccgcctgatcacggccaacccgatcgtgaccgacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcccgccggatggccatcctgggcgacacggcctgggacttcgggtccatcggcggcctgttcaccagcgtggggaagctcatccaccaggtcttcggcaccgcgtacggggtgctgttctccggcgtgagctggaccatgaagatcgggatcggcatcctgctcacgtggctgggcctgaactcccgcagcacctccctcagcatgacctgcatcgccgtcgggatggtgaccctgtacctgggcgtgatggtccaggccgactccgggtgcgtgatcaactggaagggccgcgagctcaagtgcgggagcggcatcttcgtgacgaacgaggtccacacctggaccgagcagtacaagttccaggccgactccccgaagcggctgagcgccgcgatcggcaaggcctgggaggagggggtgtgcggcatccgcagcgccacccggctggagaacatcatgtggaagcagatctccaacgagctcaactacatcctgctggagaacgacatgaagttcaccgtggtcgtgggggacgtgaacggcatcctcgcccaggggaagaagatgatccgcccccagcccatggagcacaagtacagctggaagtcctggggcaaggccaagatcatcggcgcggacacgcagaacaccaccttcatcatcgacgggcccgacaccccggagtgccccgacgaccagcgggcctggaacatctgggaggtcgaggactacggcttcgggatcttcacgaccaacatctggctgaagctgcgcgacagccacacccagatgtgcgaccaccggctcatgtccgccgccatcaaggacagcaaggcggtgcacgccgacatgggctactggatcgagtccgagaagaacgagacctggaagctggcccgcgccagcttcatcgaggtgaagacgtgcatctggcccaagtcccacaccctgtggagcaacggcgtcctcgagtccgagatggtgatccccaagacctacgggggcccgatcagccagcacaactaccggcccgggtacttcacccagacggccggcccctggcacctggggaagctggagctcgacttcgacctgtgcgagggcaccaccgtggtcgtggacgagcactgcggctaccgcgggccgtccctgcggaccacgaccgtgaccggcaagatcatccacgagtggtgctgccgcagctgcaccctgccgcccctgcggttccgcggggaggacggctgctggtacgggatggagatccggcccgtcaaggagaaggaggagaacctggtgcgctccatggtgagcgcgggctccggcgagatggacagcttcagcctcgggatcctgtgcgtctccatcctgatcgaggaggtgatgcggagccgctggtcccggaagatgctcatgacgggcaccctggccgtgttcctgctcctgatcatggggcagctgacctggaacgacctcatccgcctgtgcatcatggtcggcgccaacgccagcgaccgcatggggatgggcaccacgtacctggccctcatggccaccttcaagatgcggccgatgttcgccgtggggctgctgttccgccggctcacctcccgcgaggtgctgctgctcaccgtcgggctgagcctggtggcctccgtcgagctccccaacagcctggaggagctgggcgacgggctcgccatgggcatcatgatgctgaagctgctcacggacttccagccccaccagctgtggaccaccctgctctccctgaccttcatccggacgagcctgtccctcgactacgcctggaagaccatggcgatggccctgagcatcgtgtccctgttccccctctgcctgagcaccacctcccagaagacgacctggctgccggtgctcctgggcagcttcgggtgcaagcccctgaccatgttcctcatcaccgagaacaagatctggggccgcaagtcctggcccatcaacgaggggatcatggccgtcggcatcgtgagcatcctgctgtccagcctcctgaagaacgacgtgcccctggccgggccgctcatcgcgggcggcatgctgatcgcctgctacgtcatcagcgggtccagcgccgacctgtccctcgagaaggccgccgaggtgagctgggaggaggaggcggagcactccggcaccagccacaacatcctggtggaggtccaggacgacgggacgatgaagatcaaggacgaggagcgggacgacaccctgaccatcctcctgaaggccaccctgctcgccgtgtccggcgtgtaccccatgagcatccccgccacgctgttcgtctggtacttctggcagaagaagaagcagcgctccggggtgctgtgggacacccccagcccgcccgaggtggagcgggccgtcctggacgacggcatctaccgcatcctccagcggggcctgctggggcgctcccaggtgggcgtgggggtcttccaggacggcgtgttccacaccatgtggcacgtgacccgcggggcggtcctcatgtaccagggcaagcgcctggagcccagctgggcctccgtgaagaaggacctgatcagctacggcgggggctggcggttccaggggtcctggaacacgggcgaggaggtgcaggtcatcgccgtggagcccgggaagaacccgaagaacgtgcagaccacccccggcaccttcaagacgcccgagggcgaggtcggggccatcgccctcgacttcaagcccggcaccagcgggtccccgatcgtgaaccgcgagggcaagatcgtgggcctgtacgggaacggcgtcgtgaccaccagcgggacgtacgtgtccgcgatcgcccaggccaaggccacccaggagggccccctgcccgagatcgaggacgaggtcttcaagaagcggaacctcaccatcatggacctgcacccggggagcggcaagacccgccggtacctgcccgccatcgtgcgcgaggcgatcaagcggaagctccgcacgctgatcctggcccccacccgcgtggtcgccagcgagatggccgaggcgctcaagggcatgcccatccggtaccagaccaccgccgtgaagtccgagcacacggggcgcgagatcgtggacctgatgtgccacgccaccttcaccatgcggctgctcagcccggtccgcgtgcccaactacaacatgatcatcatggacgaggcccacttcaccgaccccgcctccatcgcggcccggggctacatcagcacgcgcgtggggatgggcgaggccgccgccatcttcatgaccgcgacgccgcccgggtccgtcgaggccttcccccagagcaacgccgtgatccaggacgaggagcgggacatccccgagcgctcctggaacagcggctacgactggatcaccgacttccccggcaagacggtgtggttcgtcccctccatcaagagcgggaacgacatcgccaactgcctgcggaagaacggcaagcgcgtgatccagctgtcccggaagaccttcgacaccgagtaccagaagaccaagaacaacgactgggactacgtggtcacgaccgacatcagcgagatgggggccaacttccgcgcggaccgggtgatcgacccccgccggtgcctcaagcccgtgatcctgaaggagggccccgagcgcgtcatcctggccgggccgatgcccgtgaccgtcgcctccgccgcgcagcggcgcggccggatcggccgcaaccagaacaaggagggggaccagtacatctacatgggccagcccctcaacaacgacgaggaccacgcccactggaccgaggccaagatgctgctggacaacatcaacacgcccgaggggatcatcccggccctcttcgagcccgagcgcgagaagtccgccgcgatcgacggcgagtaccggctgcgcggggaggcccggaagaccttcgtggagctgatgcgccggggcgacctccccgtgtggctgtcctacaaggtcgccagcgagggcttccagtactccgaccgccggtggtgcttcgacggggagcgcaacaaccaggtgctggaggagaacatggacgtggagatctggaccaaggagggcgagcggaagaagctccgcccccggtggctggacgcccgcacctacagcgacccgctggccctccgggagttcaaggagttcgcggccgggcgccggtccgtcagcggcgacctgatcctggagatcggcaagctcccccagcacctgaccctgcgcgcccagaacgccctcgacaacctggtgatgctgcacaacagcgagcagggcgggaaggcctaccggcacgcgatggaggagctccccgacacgatcgagaccctgatgctgctcgccctgatcgccgtgctgaccgggggcgtcaccctcttcttcctgtccgggaagggcctgggcaagacgagcatcgggctcctgtgcgtgatggcctccagcgcgctgctctggatggcctccgtggagccccactggatcgccgccagcatcatcctggagttcttcctgatggtcctcctgatcccggagcccgaccgccagcggacgccccaggacaaccagctggcctacgtggtgatcggcctcctgttcatgatcctgaccgtcgcggccaacgagatggggctcctggagaccacgaagaaggacctgggcatcgggcacgtggccgtggagaaccaccaccacgccaccatgctcgacgtcgacctgcgcccggcctccgcgtggaccctgtacgccgtggccaccacggtgatcacccccatgatgcggcacaccatcgagaacaccacggccaacatcagcctcaccgccatcgcgaaccaggccgccatcctgatgggcctggacaagggctggcccatctccaagatggacatcggggtccccctcctggccctgggctgctacagccaggtgaacccgctcaccctgaccgccgcggtgctgatgctcgtcgcccactacgccatcatcgggcccggcctgcaggccaaggcgacgcgcgaggcccagaagcgcaccgccgccgggatcatgaagaaccccaccgtggacggcatcgtgaccatcgacctggaccccgtcgtgtacgacgccaagttcgagaagcagctcggccagatcatgctgctgatcctctgcacgtcccagatcctgctgatgcggaccacctgggcgctctgcgagagcatcaccctggccacggggccgctgaccaccctctgggagggctcccccgggaagttctggaacaccacgatcgccgtgagcatggccaacatcttccgcggctcctacctggccggcgcggggctggccttcagcctcatgaagtccctgggcgggggccggcgcgggaccggcgcccagggcgagaccctgggggagaagtggaagcggcagctcaaccagctgagcaagtccgagttcaacacctacaagaagtccggcatcatggaggtcgaccgcagcgaggccaaggaggggctgaagcggggcgagacgaccaagcacgccgtgtcccgcgggaccgcgaagctgcggtggttcgtggagcgcaacctcgtcaagcccgagggcaaggtgatcgacctgggctgcgggcggggcgggtggagctactactgcgccggcctgaagaaggtgaccgaggtcaaggggtacaccaagggcggccccgggcacgaggagccgatccccatggccacgtacggctggaacctcgtgaagctgcactccgggaaggacgtgttcttcacgccgcccgagaagtgcgacaccctgctctgcgacatcggcgagagctccccgaaccccaccatcgaggaggggcgcacgctgcgggtcctgaagatggtggagccctggctccgcggcaaccagttctgcatcaagatcctgaacccctacatgccgagcgtggtcgagaccctggagcagatgcagcggaagcacggcgggatgctcgtgcgcaaccccctgtcccggaacagcacccacgagatgtactgggtgtcctgcggcaccgggaacatcgtcagcgccgtgaacatgacgtcccgcatgctgctcaaccggttcaccatggcgcaccgcaagcccacctacgagcgcgacgtggacctgggcgccggcacccggcacgtcgccgtggagcccgaggtggccaacctggacatcatcgggcagcgcatcgagaacatcaagaacgagcacaagagcacgtggcactacgacgaggacaacccgtacaagacctgggcctaccacggctcctacgaggtcaagcccagcgggtccgcgagctccatggtgaacggcgtcgtgcggctcctgaccaagccctgggacgtgatccccatggtcacccagatcgccatgacggacaccaccccgttcgggcagcagcgcgtgttcaaggagaaggtggacacccggacgccccgcgccaagcggggcaccgcccagatcatggaggtcaccgccaagtggctgtggggcttcctcagccgcaacaagaagccccggatctgcacccgcgaggagttcacgcggaaggtgcgctccaacgcggccatcggggccgtgttcgtcgacgagaaccagtggaacagcgccaaggaggccgtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaagatcccgggcggcaacatgtacgccgacgacaccgccgggtgggacacccggatcacggaggacgacctgcagaacgaggccaagatcaccgacatcatggagcccgagcacgccctcctggcgacctccatcttcaagctgacctaccagaacaaggtggtccgcgtgcagcgccccgccaagagcggcacggtgatggacgtcatctcccggcgcgaccagcgggggagcggccaggtgggcacctacgggctcaacaccttcaccaacatggaggtgcagctgatccgccagatggagtccgagggcatcttcagcccctccgagctggagacgccgaacctcgccaagaaggtcctggactggctggagaagcacggggccgagcggctcaagcgcatggccatcagcggcgacgactgcgtggtgaagcccatcgacgaccggttcgcgaccgccctgaccgccctgaacgacatggggaagatccgcaaggacatcccccagtgggagccctccaagggctggaacgactggcagcaggtcccgttctgcagccaccacttccaccagctcatcatgaaggacggccgggagatcgtggtgccctgccgcaaccaggacgagctggtcgggcgggcccgcgtgtcccagggcgccgggtggagcctgcgggagaccgcgtgcctcggcaagtcctacgcccagatgtggcagctgatgtacttccaccgccgggacctgcgcctcgccgccaacgccatctgcagcgcggtgcccgtcgactgggtgcccaccagccggacgacctggtccatccacgcccaccaccagtggatgaccaccgaggacatgctgagcgtgtggaaccgcgtctggatcgaggagaacccgtggatggaggacaagacgcacgtgtccagctgggaggaggtgccctacctggggaagcgggaggaccagtggtgcggctccctcatcggcctgaccgcccgcgccacctgggcgaccaacatccaggtcgccatcaaccaggtgcgccggctgatcgggaacgagaactacctcgactacatgacgagcatgaagcgcttcaagaacgagtccgaccccgagggcgccctgtggtga

SEQ ID NO: 7926 - RNA, 9879 nt, synthetic construct
  misc_feature 1..9879: note = derived and/or modified CDS sequence (opt1) from DENV-1__JX669466__SS-prME
  source 1..9879: mol_type = other RNA
agcgtgaccatgctgctcatgctgctgcccaccgccctcgccttccacctgaccacccgcggcggggagccccacatgatcgtcagcaagcaggagcggggcaagagcctgctgttcaagacctccgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgcgagaagcggtccgtggccctggcgccccacgtgggcctggggctcgagacccgcaccgagacctggatgagctccgagggcgcctggcggcagatccagcgcgtcgagacctgggccctgcggcaccccgggttcacggtgatcgccttcttcctggcgcacgccatcggcaccagcatcacccagaaggggatcatcttcatcctcctgatgctggtgaccccctccatggccatgcgctgcgtcggcatcggcaaccgggacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcgcaagctctgcatcgaggccaagatcagcaacaccaccacggactcccggtgcccgacccagggcgaggccaccctggtggaggagcaggacgccaacttcgtctgccgccggaccttcgtggaccgcggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccggaccggcctggacttcaacgagatggtcctgctcacgatgaaggagaagtcctggctggtgcacaagcagtggttcctggacctcccgctgccctggacctccggggccagcaccagccaggagacctggaaccgccaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccggctgaagatggacaagctgaccctcaagggcatgtcctacgtcatgtgcaccgggagcttcaagctggagaaggaggtggcggagacccagcacggcacgatcctggtgcaggtcaagtacgagggcaccgacgccccctgcaagatccccttctccacccaggacgagaagggggtgacccagaacggccgcctgatcacggccaacccgatcgtgaccgacaaggagaagcccgtcaacatcgagaccgagccgcccttcggggagagctacatcgtggtgggcgccggcgagaaggcgctcaagctgtcctggttcaagcgggggagctccatcggcaagatgttcgaggccaccgcccgcggggcccgccggatggccatcctgggcgacacggcgtgggacttcgggagcatcggcggcgtcttcacctccgtggggaagctcgtgcaccaggtcttcggcaccgcctacggggtgctgttcagcggcgtgtcctggaccatgaagatcgggatcggcatcctgctcacgtggctgggcctgaacagccgctccaccagcctctccatgacctgcatcgccgtcgggatggtgaccctgtacctgggcgtgatggtccaggccgacctcgggtgcgtgatcaactggaagggccgggagctgaagtgcgggagcggcatcttcgtgacgaacgaggtccacacctggaccgagcagtacaagttccaggccgactccccgaagcgcctgagcgcggccatcggcaaggcctgggaggagggggtgtgcggcatccggagcgccacccgcctcgagaacatcatgtggaagcagatctccaacgagctgaaccacatcctgctcgagaacgacatgaagttcaccgtggtcgtgggggacgccaacggcatcctggcgcaggggaagaagatgatccggccccagcccatggagcacaagtacagctggaagtcctggggcaaggccaagatcatcggcgccgacatccagaacacgaccttcatcatcgacgggcccgacaccccggagtgccccgacggccagcgcgcctggaacatctgggaggtggaggactacgggttcggcgtcttcaccacgaacatctggctgaagctccgggacagctacacccagatgtgcgaccaccgcctgatgtccgcggccatcaaggacagcaaggccgtgcacgccgacatgggctactggatcgagtccgagaagaacgagacctggaagctggcccgggcgagcttcatcgaggtgaagacctgcacgtggcccaagtcccacaccctctggagcaacggggtcctggagtccgagatgatcatccccaagatcttcggcgggccgatcagccagcacaactaccgccccggctacttcacccagaccgccgggccctggcacctgggcaagctcgagctggacttcgacctgtgcgagggcacgaccgtggtggtcgacgagcactgcgggaaccggggcccgtccctccgcaccaccacggtgaccgggaagatcatccacgagtggtgctgccggagctgcaccctgccgcccctgcgcttccggggcgaggacgggtgctggtacggcatggagatccgccccgtgaaggagaaggaggagaacctcgtccggtccatggtgagcgccggctccggggaggtggacagcttcagcctgggcatcctgtgcgtctccatcatgatcgaggaggtgatgcgcagccgctggtcccggaagatgctcatgaccgggacgctggccgtgttcctgctcctgatcatgggccagctgacctggaacgacctcatccgcctgtgcatcatggtcggggccaacgcgagcgaccggatgggcatgggcaccacctacctggccctcatggccacgttcaagatgcgcccgatgttcgccgtggggctgctgttccggcgcctcacctcccgggaggtgctgctgctcaccatcggcctgagcctggtcgcctccgtggagctccccaacagcctggaggagctgggggacggcctcgcgatgggcatcatgatgctgaagctgctcaccgagttccagccccaccagctgtggacgaccctgctctccctgaccttcgtcaagaccacgctgagcctcgactacgcctggaagaccaccgccatggtgctgtccatcgtgagcctgttccccctctgcctgtccaccacgagccagaagaccacctggctgccggtcctcctggggtccttcggctgcaagcccctgaccatgttcctcatcaccgagaacaagatctgggggcgcaagagctggcccctgaacgagggcatcatggccatcgggatcgtgtccatcctgctcagctccctgctgaagaacgacgtgcccctcgcgggcccgctgatcgccggcgggatgctgatcgcctgctacgtcatcagcggcagctccgccgacctcagcctggagaaggccgcggaggtgtcctgggagcaggaggccgagcacagcggggcctcccacaacatcctggtggaggtccaggacgacggcacgatgaagatcaaggacgaggagcgggacgacaccctcaccatcctgctgaaggccaccctcctggccgtgagcggggtgtaccccatgtccatccccgcgacgctgttcgtctggtacttctggcagaagaagaagcagcgcagcggcgtgctctgggacaccccctccccgcccgaggtggagcgggccgtcctggacgacggcatctaccgcatcctgcagcgggggctgctcggccgcagccaggtgggggtgggcgtcttccaggacggggtgttccacaccatgtggcacgtgacccggggcgccgtcctgatgtaccagggcaagcgcctggagccctcctgggccagcgtgaagaaggacctcatctcctacgggggcgggtggcggttccagggcagctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggacctccggcagcccgatcgtgaaccgcgagggcaagatcgtggggctgtacggcaacggggtcgtgaccacctccggcacgtacgtgagcgccatcgcccaggccaaggcgtcccaggaggggcccctccccgagatcgaggacgaggtcttcaagaagcggaacctgaccatcatggacctgcacccgggcagcggcaagacccgccggtacctccccgccatcgtgcgcgaggccatcaagcgcaagctgcggaccctgatcctcgcccccacgcgcgtggtcgcgagcgagatggccgaggccctgaaggggatgcccatccggtaccagaccaccgccgtgaagtccgagcacaccggccgcgagatcgtggacctgatgtgccacgccacgttcaccatgcggctcctgagcccggtccgcgtgcccaactacaacatgatcatcatggacgaggcgcacttcaccgaccccgcctccatcgccgcccgggggtacatcagcacccgcgtgggcatgggggaggccgcggccatcttcatgacggccacgccgcccggctccgtcgaggccttcccccagagcaacgccgtgatccaggacgaggagcgggacatccccgagcgctcctggaacagcggctacgactggatcaccgacttccccgggaagaccgtgtggttcgtcccctccatcaagagcggcaacgacatcgcgaactgcctgcggaagaacgggaagcgcgtgatccagctctcccggaagacgttcgacaccgagtaccagaagaccaagaacaacgactgggactacgtggtcaccacggacatcagcgagatgggcgccaacttccgcgccgaccgggtgatcgacccccgccggtgcctgaagcccgtgatcctgaaggacgggcccgagcgcgtcatcctcgccggcccgatgcccgtgaccgtcgcgtccgccgcccagcggcgcggccgcatcgggcggaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagacgttcgtggagctcatgcgccggggcgacctgcccgtctggctgtcctacaaggtggccagcgaggggttccagtactccgaccgccggtggtgcttcgacggcgagcgcaacaaccaggtgctcgaggagaacatggacgtcgagatctggaccaaggagggggagcggaagaagctgcgcccccggtggctggacgcgcgcacctacagcgacccgctcgccctgcgggagttcaaggagttcgccgccggccgccggtccgtgagcggcgacctgatcctcgagatcgggaagctgccccagcacctgaccctccgcgcccagaacgcgctggacaacctggtgatgctccacaacagcgagcagggcgggaaggcctaccggcacgccatggaggagctgcccgacaccatcgagacgctgatgctcctggccctgatcgcggtcctcaccggcggggtgaccctgttcttcctgtccggcaagggcctcgggaagaccagcatcggcctgctgtgcgtgacggcctccagcgccctcctgtggatggcctccgtcgagccccactggatcgccgcgagcatcatcctggagttcttcctcatggtgctgctgatcccggagcccgaccgccagcggacgccccaggacaaccagctcgcctacgtggtcatcgggctgctgttcatgatcctcaccgtggccgccaacgagatgggcctgctggagaccacgaagaaggacctcgggatcggctacgtggccgcggagaaccaccagcacgccaccatgctggacgtcgacctgcacccggcctccgcctggaccctctacgccgtggcgaccacggtgatcacccccatgatgcgccacaccatcgagaacaccacggccaacatcagcctgaccgccatcgccaaccaggccgcgatcctgatgggcctcgacaaggggtggcccatctccaagatggacatcggcgtccccctgctggccctcgggtgctacagccaggtgaacccgctgaccctgaccgccgccgtgctcatgctggtcgcgcactacgccatcatcggccccgggctgcaggccaaggccacgcgcgaggcccagaagcggaccgcggccggcatcatgaagaaccccaccgtggacggcatcgtggccatcgacctcgaccccgtcgtgtacgacgccaagttcgagaagcagctggggcagatcatgctgctcatcctgtgcacctcccagatcctgctcatgcgcacgacctgggccctgtgcgagagcatcaccctggcgaccggcccgctcacgaccctgtgggaggggtcccccggcaagttctggaacaccaccatcgccgtgagcatggccaacatcttccggggctcctacctggccggggccggcctcgcgttcagcctgatgaagtccctcgggggcgggcgccggggcacgggcgcccagggggagaccctcggcgagaagtggaagcgccagctgaaccagctgagcaagtccgagttcaacacctacaagcggagcgggatcatggaggtcgaccgcagcgaggccaaggagggcctcaagcgcggggagaccacgaagcacgccgtgtcccgcggcaccgcgaagctgcggtggttcgtggagcgcaacctggtcaagcccgagggcaaggtgatcgacctggggtgcggccgcgggggctggagctactactgcgccgggctcaagaaggtgaccgaggtcaagggctacaccaagggcgggcccggccacgaggagccgatccccatggccacctacgggtggaacctggtgaagctgcactccggcaaggacgtgttcttcatgccgcccgagaagtgcgacacgctcctgtgcgacatcggggagagctccccgaaccccaccatcgaggagggccgcaccctgcgggtcctcaagatggtggagccctggctgcgcggcaaccagttctgcatcaagatcctgaacccctacatgccgagcgtggtcgagaccctcgagcagatgcagcggaagcacgggggcatgctggtgcgcaaccccctgtcccggaacagcacgcacgagatgtactgggtgtcctgcgggaccggcaacatcgtcagcgccgtgaacatgacctcccgcatgctcctgaaccgcttcaccatggcccaccggaagcccacgtacgagcgcgacgtggacctgggcgcggggacccggcacgtcgccgtggagcccgaggtggccaacctcgacatcatcggccagcgcatcgagaacatcaagaacgagcacaagagcacctggcactacgacgaggacaacccgtacaagacctgggcctaccacgggtcctacgaggtcaagcccagcggctccgccagctccatggtgaacggggtcgtgcggctgctgacgaagccctgggacgtgatccccatggtcacccagatcgcgatgaccgacaccacgccgttcggccagcagcgcgtgttcaaggagaaggtggacacccggacgccccgggccaagcggggcaccacgcagatcatggaggtcaccgccaagtggctctgggggttcctgagccgcaacaagaagccccggatctgcacccgcgaggagttcacccggaaggtgcgctccaacgccgccatcggcgcggtgttcgtcgacgagaaccagtggaacagcgccaaggaggccgtggaggacgagcggttctgggacctggtgcaccgcgagcgggagctccacaagcaggggaagtgcgccacgtgcgtctacaacatgatgggcaagcgcgagaagaagctgggggagttcggcaaggcgaagggcagccgggccatctggtacatgtggctgggggcccgcttcctcgagttcgaggccctgggcttcatgaacgaggaccactggttctcccgggagaacagcctgtccggggtggagggcgaggggctccacaagctgggctacatcctgcgcgacatcagcaagatcccgggcgggaacatgtacgccgacgacaccgcgggctgggacacccgcatcaccgaggacgacctccagaacgaggccaagatcacggacatcatggagcccgagcacgccctgctggccacctccatcttcaagctcacctaccagaacaaggtggtccgggtgcagcgccccgccaagaacgggaccgtgatggacgtcatcagccggcgcgaccagcggggctccggccaggtggggacgtacggcctgaacaccttcaccaacatggaggtgcagctgatccgccagatggagagcgaggggatcttcctcccctccgagctggagaccccgaacctggcggagcgggccctcgactggctggagaagcacggcgccgagcgcctgaagcggatggccatcagcggggacgactgcgtcgtgaagcccatcgacgaccgcttcgccacggcgctcaccgccctgaacgacatgggcaaggtgcggaaggacatcccccagtgggagccctccaagggctggaacgactggcagcaggtcccgttctgcagccaccacttccaccagctgatcatgaaggacgggcgcgagatcgtggtgccctgccggaaccaggacgagctcgtcggccgcgcccgggtgtcccagggggccggctggagcctgcgcgagaccgcctgcctggggaagtcctacgcgcagatgtggcagctcatgtacttccaccggcgcgacctgcggctggccgccaacgccatctgcagcgcggtgcccgtcgactgggtgcccgcctcccgcaccacctggagcatccacgcccaccaccagtggatgacgaccgaggacatgctcagcgtgtggaaccgcgtctggatcgaggagaacccgtggatggaggacaagacccacgtgtccagctgggaggaggtgccctacctgggcaagcgggaggaccagtggtgcggctccctgatcgggctcaccgcccgcgccacgtgggcgaccaacatccaggtcgccatcaaccaggtgcggcgcctgatcggcaacgagaactacctggactacatgaccagcatgaagcggttcaagaacgagtccgaccccgagggggccctctggtga

SEQ ID NO: 7927 - RNA, 9879 nt, synthetic construct
  misc_feature 1..9879: note = derived and/or modified CDS sequence (opt1) from DENV-1__JX669467__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgggacaagcggtccgtggccctggcgccccacgtgggcctggggctcgagacgcggaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccgcctcatcaccgccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgcgagctgaagtgcgggtccggcatcttcgtcaccaacgaggtgcacacctggaccgagcagtacaagttccaggccgacagcccgaagcggctgagcgcggccatcggccgcgcctgggaggagggggtgtgcggcatccggtccgccacccgcctcgagaacatcatgtggaagcagatcagcaacgagctgaaccacatcctgctcgagaacgacatcaagttcacggtcgtggtggggaacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacgagcagcgcgcctggaacatctgggaggtcgaggactacggcttcgggatcttcacgaccaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatgtacgggggcccgatctcccagcacaactaccgccccgggtacttcacccagaccgccggcccctggcacctggggaagctcgagctggacttcgacctgtgcgagggcacgaccgtggtggtcgacgagcactgcggcagccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtccggtccatggtgagcgccggcagcggcgaggtggactccttcagcctggggatcctgtgcgtctccatcatgatcgaggaggtgatgcgcagccggtggtcccgcaagatgctcatgaccggcacgctggccgtgttcctgctcctgatcatggggcagctgacctggaacgacctcatccgcctgtgcatcatggtcggcgccaacgcgagcgacaagatggggatgggcaccacctacctggccctcatggccacgttcaagatgcggccgatgttcgccgtggggctgctgttccgccggctcacctcccgcgaggtgctgctgctcaccatcgggctgagcctggtcgcctccgtggagctccccaacagcctggaggagctgggcgacgggctcgcgatgggcatcatgatgctgaagctgctcaccgagttccagccccaccagctgtggacgaccctgctctccctgaccttcatcaagaccacgctgagcctcgactacgcctggaagaccaccgccaccgtcctgtccatcgtgagcctgttccccctctgcctgtccacgaccagccagaagaccacctggctgccggtgctcctgggctccttcgggtgcaagcccctgaccatgttcctcatcacggagaacgagatctggggccgcaagagctggcccctgaacgaggggatcatggccatcggcatcgtctccatcctgctcagcagcctgctgaagaacgacgtgcccctcgcggggccgctgatcgccggcggcatgctgatcgcctgctacgtgatctccgggagctccgccgacctcagcctggagaaggccgcggaggtctcctgggaggaggaggccgagcacagcggcacctcccacaacatcctggtggaggtgcaggacgacgggaccatgaagatcaaggacgaggagcgcgacgacaccctcacgatcctgctgaaggccaccctcctggccgtcagcggcgtgtaccccatgtccatccccgccaccctgttcgtgtggtacttctggcagaagaagaagcagcggagcggggtcctctgggacaccccctccccgcccgaggtggagcgcgcggtgctggacgacggcatctaccggatcctgcagcgcggcctgctcgggcggagccaggtcggcgtgggggtgttccaggacggcgtcttccacacgatgtggcacgtgacccgcggggccgtgctgatgtaccagggcaagcggctggagccctcctgggccagcgtcaagaaggacctcatctcctacggcgggggctggcgcttccaggggagctggaacaccggcgaggaggtccaggtgatcgccgtcgagcccgggaagaacccgaagaacgtgcagaccacgcccggcaccttcaagacccccgagggcgaggtgggggccatcgcgctggacttcaagcccggcacctccgggagcccgatcgtcaaccgggagggcaagatcgtgggcctgtacgggaacggcgtggtcacgacctccgggacctacgtgagcgccatcgcccaggccaaggccagccaggagggccccctccccgagatcgaggacgaggtgttcaagaagcgcaacctgaccatcatggacctgcacccggggtccggcaagacgcggcgctacctccccgcgatcgtccgggaggccatcaagcgcaagctgcggaccctgatcctcgcccccacccgcgtggtggccagcgagatggcggaggccctgaagggcatgcccatccgctaccagaccacggccgtcaagtccgagcacaccgggcgggagatcgtggacctgatgtgccacgccaccttcaccatgcgcctcctgagcccggtgcgggtccccaactacaacatgatcatcatggacgaggcccacttcacggaccccgcgtccatcgccgcccgcggctacatcagcacccgggtggggatgggcgaggccgccgcgatcttcatgaccgccacgccgcccgggtccgtggaggccttcccccagagcaacgccgtcatccaggacgaggagcgcgacatccccgagcggtcctggaacagcggctacgactggatcacggacttccccggcaagaccgtgtggttcgtgccctccatcaagagcgggaacgacatcgccaactgcctgcgcaagaacggcaagcgggtcatccagctctcccgcaagaccttcgacaccgagtaccagaagacgaagaacaacgactgggactacgtggtgaccaccgacatcagcgagatgggggcgaacttccgggccgaccgcgtcatcgacccccggcgctgcctgaagcccgtgatcctgaaggacggccccgagcgggtgatcctcgccgggccgatgcccgtcaccgtggcctccgcggcccagcgccggggccgcatcggccggaaccagaacaaggagggggaccagtacgtctacatgggccagcccctgaacaacgacgaggaccacgcccactggacggaggccaagatgctgctcgacaacatcaacacccccgaggggatcatcccggccctgttcgagcccgagcgcgagaagtccgcggccatcgacggcgagtaccgcctgcgcggggaggcccgcaagaccttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacctacagcgacccgctcgcgctgcgcgagttcaaggagttcgccgccgggcggcgcagcgtctccggcgacctgatcctcgagatcggcaagctgccccagcacctgacgctccgggcccagaacgccctggacaacctggtgatgctccacaacagcgagcagggcgggaaggcgtaccgccacgccatggaggagctgcccgacaccatcgagaccctgatgctcctggccctgatcgccgtgctcaccgggggcgtcacgctgttcttcctgtccgggaagggcctcggcaagaccagcatcgggctgctgtgcgtgaccgcgtccagcgccctcctgtggatggcctccgtggagccccactggatcgccgccagcatcatcctggagttcttcctcatggtcctgctgatcccggagcccgaccggcagcgcacgccccaggacaaccagctcgcgtacgtggtgatcggcctgctgttcatgatcctcacggtcgccgccaacgagatggggctgctggagaccaccaagaaggacctcggcatcgggcacgtggccgccgagaaccaccagcacgcgaccatgctggacgtggacctgcacccggcctccgcctggacgctctacgccgtcgccaccaccgtgatcacccccatgatgcggcacacgatcgagaacaccaccgcgaacatcagcctgaccgccatcgccaaccaggccgccatcctgatgggcctcgacaagggctggcccatctccaagatggacctgggggtgcccctgctcgcgctgggctgctacagccaggtcaacccgctgacgctcaccgccgccgtgctgatgctggtggcccactacgcgatcatcgggcccggcctccaggccaaggccacccgcgaggcccagaagcggaccgccgcggggatcatgaagaaccccacggtcgacggcatcgtggccatcgacctggaccccgtggtctacgacgccaagttcgagaagcagctgggccagatcatgctcctgatcctgtgcacctcccagatcctcctgatgcgcaccacctgggccctgtgcgagagcatcacgctcgccaccgggccgctgaccaccctgtgggagggctcccccgggaagttctggaacacgaccatcgcggtgagcatggccaacatcttccgcggctcctacctcgccggcgccgggctggccttcagcctgatgaagtccctcggcgggggccggcgcgggaccggcgcgcagggcgagaccctgggggagaagtggaagcggcagctgaaccagctcagcaagagcgagttcaacacgtacaagcgctccggcatcatggaggtggaccggagcgaggccaaggaggggctgaagcgcggcgagaccaccaagcacgccgtctcccgggggaccgccaagctgcgctggttcgtggagcggaacctggtgaagcccgagggcaaggtcatcgacctcggctgcgggcgcggcgggtggagctactactgcgcgggcctgaagaaggtgaccgaggtgaaggggtacacgaagggcggccccgggcacgaggagccgatccccatggccacctacggctggaacctggtcaagctccactccgggaaggacgtgttcttcatgccgcccgagaagtgcgacaccctgctgtgcgacatcggcgagagctccccgaaccccaccatcgaggaggggcggacgctccgcgtgctgaagatggtcgagccctggctgcggggcaaccagttctgcatcaagatcctcaacccctacatgccgagcgtggtggagaccctggagcagatgcagcgcaagcacggcgggatgctggtccggaaccccctctcccgcaacagcacccacgagatgtactgggtgtcctgcggcaccgggaacatcgtgagcgccgtcaacatgacgtcccggatgctgctgaaccgcttcaccatggcccaccggaagcccacctacgagcgcgacgtggacctcggcgccggcacccgccacgtggcggtcgagcccgaggtggccaacctggacatcatcgggcagcggatcgagaacatcaagaacgagcacaagagcacgtggcactacgacgaggacaacccgtacaagacctgggcctaccacggctcctacgaggtgaagcccagcgggtccgccagctccatggtcaacggcgtggtccgcctgctcaccaagccctgggacgtgatccccatggtgacccagatcgccatgacggacaccaccccgttcgggcagcagcgggtcttcaaggagaaggtggacacccgcacgccccgggcgaagcgcggcaccgcccagatcatggaggtgaccgccaagtggctgtggggcttcctgagccggaacaagaagccccgcatctgcacccgggaggagttcacgcgcaaggtccggagcaacgccgccatcggggcggtgttcgtggacgagaaccagtggaactccgccaaggaggccgtcgaggacgagcgcttctgggacctcgtgcaccgggagcgcgagctgcacaagcagggcaagtgcgcgacctgcgtgtacaacatgatggggaagcgggagaagaagctgggcgagttcgggaaggcgaagggcagccgcgccatctggtacatgtggctcggcgcccggttcctggagttcgaggccctggggttcatgaacgaggaccactggttctcccgcgagaacagcctctccggcgtcgagggggagggcctgcacaagctggggtacatcctccgggacatcagcaagatcccgggcggcaacatgtacgccgacgacaccgcggggtgggacacccgcatcacggaggacgacctgcagaacgaggccaagatcaccgacatcatggagcccgagcacgccctgctcgccacctccatcttcaagctgacctaccagaacaaggtggtgcgggtccagcgccccgccaagaacggcacggtgatggacgtgatcagccgccgggaccagcgcgggtccggccaggtcggcacctacgggctgaacaccttcaccaacatggaggtgcagctcatccggcagatggagagcgagggcatcttcttcccctccgagctggagagcccgaacctggcggagcgcgtgctcgactggctggagaagcacggggccgagcggctgaagcgcatggccatctccggcgacgactgcgtcgtgaagcccatcgacgaccggttcgccacggccctcatcgcgctgaacgacatggggaaggtgcgcaaggacatcccccagtgggagcccagcaagggctggaacgactggcagcaggtcccgttctgctcccaccacttccaccagctgatcatgaaggacggccgggagatcgtggtgccctgccgcaaccaggacgagctcgtcgggcgggcccgcgtgagccagggcgccgggtggtccctgcgggagaccgcctgcctgggcaagagctacgcccagatgtggcagctcatgtacttccaccgccgggacctgcgcctggcggccaacgccatctgcagcgccgtgcccgtcgactgggtgcccacctcccggaccacctggagcatccacgcgcaccaccagtggatgacgaccgaggacatgctctccgtgtggaaccgcgtctggatcgaggagaacccgtggatggaggacaagacccacgtgagctcctgggaggaggtgccctacctggggaagcgggaggaccagtggtgcggcagcctgatcggcctcaccgcccgcgccacgtgggccaccaacatccaggtcgccatcaaccaggtgcgccggctgatcgggaacgagaactacctggactacatgacctccatgaagcgcttcaagaacgagagcgaccccgagggcgcgctctggtga

SEQ ID NO: 7928 - RNA, 9879 nt, synthetic construct
  misc_feature 1..9879: note = derived and/or modified CDS sequence (opt1) from DENV-1__HM469967__SS-prME
  source 1..9879: mol_type = other RNA
agcgtgaccatgctgctcatgctgatgcccaccgccctggccttccacctcaccacccggggcggggagccccacatgatcgtcagcaagcaggagcggggcaagagcctgctgttcaagaccagcgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtcacctacgggacctgcagccagaccggcgagcaccggcgggacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcaccctggccgtgttcttcctgctcatcatggggcagctgacgtggaacgacctgatccgcctctgcatcatggtcggcgcgaacgccagcgaccgcatggggatgggcaccacctacctggccctgatggccaccttcaagatgcggccgatgttcgccgtgggcctcctgttccgccggctgacgtcccgcgaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccggaagtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccaaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgagatcggcgccatcgcgctggacttcaagcccgggacgagcggctcccccatcgtcaaccgggaggggaagatcgtgggcctgtacggcaacggggtggtcaccaccagcggcacctacgtgagcgccatcgcccaggccaaggcgtcccaggaggggccgctccccgagatcgaggacgaggtgttccgcaagcggaacctgacgatcatggacctgcaccccggcagcgggaagacccgccggtacctcccggccatcgtccgcgaggccatcaagcggaagctgcgcaccctgatcctcgcccccacccgcgtggtggcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtgcgggtcccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaaggccggcaacgacatcgcgaactgcctgcgcaagaacgggaagcgggtcatccagctcagccgcaagaccttcgacacggagtaccagaagaccaagaactccgactgggactacgtggtgaccaccgacatcagcgagatgggcgccaacttccgggccgaccgcgtcatcgacccgcggcgctgcctgaagcccgtgatcctgaaggacgggcccgagcgggtgatcctcgccggccccatgccggtcacggtggcctccgcggcccagcgccgggggcgcgtcggccggaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgcggccatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgcgctgcgcgagttcaaggagttcgccgccggccggcgcagcgtctccggggacctgatcctcgagatcggcaagctgccgcagcacctgacccagcgggcccagaacgcgctcgacaacctggtgatgctgcacaacagcgagcagggcgggcgcgcctaccggcacgccatggaggagctccccgacaccatcgagacgctgatgctgctcgccctgatcgccgtgctgaccggcggggtcaccctcttcttcctgtccggccgcgggctgggcaagaccagcatcggcctcctgtgcgtgatggcgtccagcgtgctgctctggatggcctccgtcgagccccactggatcgccgccagcatcatcctggagttcttcctgatggtgctcctgatccccgagccggaccggcagcgcacgccccaggacaaccagctggcctacgtggtcatcgggctcctgttcatgatcctgacggtggcggccaacgagatgggcctcctggagaccaccaagaaggacctggggatcggccacgtggccgtcgagaaccaccaccacgccgccatgctcgacgtggacctgcaccccgcgtccgcctggaccctgtacgccgtggccacgaccatcatcaccccgatgatgcggcacaccatcgagaacacgaccgccaacatcagcctcaccgcgatcgccaaccaggccgccatcctgatggggctggacaagggctggcccatctccaagatggacatcggcgtccccctcctggcgctggggtgctacagccaggtgaaccccctcaccctgacggccgccgtgctgatgctcgtcgcccactacgccatcatcggcccggggctgcaggcgaaggccacccgcgaggcccagaagcgcaccgccgccggcatcatgaagaaccccaccgtggacgggatcgtggcgatcgacctggaccccgtcgtgtacgacgccaagttcgagaagcagctcggccagatcatgctgctgatcctctgcacgtcccagatcctgctgatgcggaccacctgggccctctgcgagagcatcaccctggccacgggccccctgaccaccctctggaaggggtccccgggcaagttctggaacaccacgatcgccgtgagcatggcgaacatcttccgcgggtcctacctggccggcgccggcctggccttcagcctcatgaagtccctcgggggcgggcggcgcgggaccggggcgcagggcgagaccctgggcgagaagtggaagcggcagctcaaccagctgtccaagagcgagttcaacacctacaagcgctccgggatcatggaggtcgaccggagcgaggccaaggagggcctgaagcgcggggagacgaccaagcacgccgtgtcccggggcaccgccaagctcaagtggttcgtggagcgcaacctggtcaagcccgaggggaaggtgatcgacctgggctgcggccgcgggggctggagctactactgcgccgggctgaagaaggtgaccgaggtcaagggctacacgaagggcggccccggccacgaggagcccatcccgatggcgacctacgggtggaacctcgtgaagctgcactccggcaaggacgtgttcttcatcccgcccgagaagtgcgacaccctgctctgcgacatcggggagagctcccccaacccgaccatcgaggagggccgcacgctgcgggtcctgaagatggtggagccctggctccgcaagaaccagttctgcatcaagatcctgaacccctacatgcccagcgtggtcgagaccctggagcagatgcagcggaagcacgggggcatgctcgtgcgcaacccgctgtcccggaacagcacccacgagatgtactgggtgtcctgcggcaccgggaacatcgtcagcgccgtgaacatgacctcccgcatgctgctcaaccggttcacgatggcccaccgcaagcccacctacgagcgcgacgtggacctgggcgccgggacccggcacgtcgccgtggagcccgaggtggcgaacctggacatcatcggccagcgcatcgagaacatcaagcacgagcacaagagcacctggcactacgacgaggacaacccctacaagacgtgggcctaccacggctcctacgaggtcaagccgagcgggtccgccagcagcatggtgaacggcgtcgtgaagctcctgaccaagccctgggacgtgatccccatggtcacccagatcgccatgaccgacacgacccccttcgggcagcagcgggtgttcaaggagaaggtggacacccgcaccccgaaggccaagcggggcacggcgcagatcatggaggtcaccgcccgctggctgtgggggttcctctcccggaacaagaagccccgcatctgcacccgggaggagttcacccgcaaggtgcggagcaacgccgccatcggcgcggtgttcgtcgacgagaaccagtggaactccgccaaggaggccgtggaggacgagcgcttctgggacctggtgcaccgggagcgcgagctgcacaagcagggcaagtgcgccacgtgcgtctacaacatgatggggaagcgggagaagaagctcggcgagttcgggaaggccaagggcagccgcgcgatctggtacatgtggctgggggcccggttcctggagttcgaggccctcggcttcatgaacgaggaccactggttctcccgcgagaacagcctgtccggcgtggagggggagggcctgcacaagctcgggtacatcctgcgggacatcagcaagatccccggcgggaacatgtacgccgacgacaccgccggctgggacacccgcatcaccgaggacgacctgcagaacgaggcgaagatcacggacatcatggagccggagcacgccctcctggccaagtccatcttcaagctgacctaccagaacaaggtggtccgggtgcagcgccccgccaagaacggcaccgtgatggacgtcatcagccgccgggaccagcgcgggtccggccaggtggggacctacggcctcaacacgttcaccaacatggaggcccagctgatccggcagatggagagcgagggcatcttctcccccagcgagctggagacccccaacctcgcggagcgcgtgctggactggctggagaagtacggggtcgagcggctcaagcgcatggccatctccggcgacgactgcgtggtgaagccgatcgacgaccggttcgccaccgccctgacggccctgaacgacatggggaaggtccgcaaggacatcccccagtgggagcccagcaagggctggaacgactggcagaaggtgcccttctgctcccaccacttccaccagctcatcatgaaggacgggcgggagatcgtggtcccgtgccgcaaccaggacgagctggtgggccgggcgcgcgtgagccagggcgccgggtggagcctgcgggagaccgcctgcctcggcaagtcctacgcccagatgtggcagctgatgtacttccaccgccgggacctgcgcctcgcggccaacgccatctgcagcgccgtccccgtggactgggtgcccacctcccggaccacgtggagcatccacgcccaccaccagtggatgaccaccgaggacatgctgtccgtctggaaccgcgtgtggatcgaggagaacccctggatggaggacaagacccacatcagctcctgggaggacgtgccgtacctggggaagcgggaggaccagtggtgcggcagcctcatcgggctgacggcgcgcgccacctgggccaccaacatccaggtcgccatcaaccaggtgcgccggctgatcggcaacgagaactacctcgactacatgacctccatgaagcgcttcaagaacgagagcgaccccgagggcgccctgtggtga

SEQ ID NO: 7929 - RNA, 9879 nt, synthetic construct
  misc_feature 1..9879: note = derived and/or modified CDS sequence (opt1) from DENV-1__JX669468__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgggacaagcggtccgtggccctggcgccccacgtgggcctggggctcgagacgcgcaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccgcctcatcaccgccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgcgagctgaagtgcgggaacggcatcttcgtcaccaacgaggtgcacacctggaccgagcagtacaagttccaggccgactccccgaagcggctgagcgcggccatcggccgcgcctgggaggagggggtgtgcggcatccggagcgccacccgcctcgagaacatcatgtggaagcagatctccaacgagctgaaccacatcctgctcgagaacgacatcaagttcacggtcgtggtggggaacgccaacggcatcctggcgcaggggaagaagatgatccggccccagcccatggagcacaagtacagctggaagtcctggggcaaggccaagatcatcggcgccgacatccagaacaccaccttcatcatcgacgggcccgacaccccggagtgccccgacgagcagcgcgcctggaacatctgggaggtcgaggactacggcttcgggatcttcacgaccaacatctggctgaagctccgggacagctacacccagatgtgcgaccaccgcctgatgtccgcggccatcaaggacagcaaggccgtgcacgccgacatgggctactggatcgagtccgagaagaacgagacctggaagctggcccgggcgagcttcatcgaggtgaagacgtgcatctggcccaagtcccacaccctctggagcaacggcgtcctggagtccgagatgatcatccccaagatgtacgggggcccgatcagccagcacaactaccgccccgggtacttcacccagaccgccggcccctggcacctggggaagctcgagctggacttcgacctgtgcgagggcacgaccgtggtggtcgacgagcactgcggctcccgggggccgagcctccgcaccaccacggtgaccggcaagatcatccacgagtggtgctgccggtcctgcaccctgccgcccctgcgcttccgcggggaggacggctgctggtacgggatggagatccgccccgtgaaggagaaggaggagaacctcgtccggagcatggtgtccgccggcagcggcgaggtggacagcttctccctggggatcctgtgcgtcagcatcatgatcgaggaggtgatgcgctcccggtggagccgcaagatgctcatgaccggcacgctggccgtgttcctgctcctgatcatggggcagctgacctggaacgacctcatccgcctgtgcatcatggtcggcgccaacgcgtccgacaagatggggatgggcaccacctacctggccctcatggccacgttcaagatgcggccgatgttcgccgtggggctgctgttccgccggctcaccagccgcgaggtgctgctgctcaccatcgggctgtccctggtcgccagcgtggagctccccaactccctggaggagctgggcgacgggctcgcgatgggcatcatgatgctgaagctgctcaccgagttccagccccaccagctgtggacgaccctgctcagcctgaccttcatcaagaccacgctgtccctcgactacgcctggaagaccaccgccaccgtcctgagcatcgtgtccctgttccccctctgcctgagcacgacctcccagaagaccacctggctgccggtgctcctgggcagcttcgggtgcaagcccctgaccatgttcctcatcacggagaacgagatctggggccggaagtcctggcccctgaacgaggggatcatggccatcggcatcgtcagcatcctgctctccagcctgctgaagaacgacgtgcccctcgcggggccgctgatcgccggcggcatgctgatcgcctgctacgtgatcagcgggtccagcgccgacctctccctggagaaggccgcggaggtcagctgggaggaggaggccgagcactccggcaccagccacaacatcctggtggaggtgcaggacgacgggaccatgaagatcaaggacgaggagcgcgacgacaccctcacgatcctgctgaaggccaccctcctggccgtctccggcgtgtaccccatgagcatccccgccaccctgttcgtgtggtacttctggcagaagaagaagcagcggtccggggtcctctgggacacccccagcccgcccgaggtggagcgcgcggtgctggacgacggcatctaccggatcctgcagcgcggcctgctcgggcggtcccaggtcggcgtgggggtgttccaggacggcgtcttccacacgatgtggcacgtgacccgcggggccgtgctgatgtaccagggcaagcggctggagcccagctgggcctccgtcaagaaggacctcatcagctacggcgggggctggcgcttccaggggtcctggaacaccggcgaggaggtccaggtgatcgccgtcgagcccgggaagaacccgaagaacgtgcagaccacgcccggcaccttcaagacccccgagggcgaggtgggggccatcgcgctggacttcaagcccggcaccagcgggtccccgatcgtcaaccgggagggcaagatcgtgggcctgtacgggaacggcgtggtcacgaccagcgggacctacgtgtccgccatcgcccaggccaaggccagccaggagggccccctccccgagatcgaggacgaggtgttcaagaagcgcaacctgaccatcatggacctgcacccggggagcggcaagacgcggcgctacctccccgcgatcgtccgggaggccatcaagcgcaagctgcggaccctgatcctcgcccccacccgcgtggtggcctccgagatggcggaggccctgaagggcatgcccatccgctaccagaccacggccgtcaagagcgagcacaccgggcgggagatcgtggacctgatgtgccacgccaccttcaccatgcgcctcctgtccccggtgcgggtccccaactacaacatgatcatcatggacgaggcccacttcacggaccccgcgagcatcgccgcccgcggctacatctccacccgggtggggatgggcgaggccgccgcgatcttcatgaccgccacgccgcccgggagcgtggaggccttcccccagtccaacgccgtcatccaggacgaggagcgcgacatccccgagcggagctggaactccggctacgactggatcacggacttccccggcaagaccgtgtggttcgtgcccagcatcaagtccgggaacgacatcgccaactgcctgcgcaagaacggcaagcgggtcatccagctcagccgcaagaccttcgacaccgagtaccagaagacgaagaacaacgactgggactacgtggtgaccaccgacatctccgagatgggggcgaacttccgggccgaccgcgtcatcgacccccggcgctgcctgaagcccgtgatcctgaaggacggccccgagcgggtgatcctcgccgggccgatgcccgtcaccgtggccagcgcggcccagcgccggggccgcatcggccggaaccagaacaaggagggggaccagtacgtctacatgggccagcccctgaacaacgacgaggaccacgcccactggacggaggccaagatgctgctcgacaacatcaacacccccgaggggatcatcccggccctgttcgagcccgagcgcgagaagtccgcggccatcgacggcgagtaccgcctgcgcggggaggcccgcaagaccttcgtggagctcatgcggcgcggcgacctgcccgtgtggctgagctacaaggtcgcctccgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgacccgctcgcgctgcgcgagttcaaggagttcgccgccgggcggcgcagcgtcagcggcgacctgatcctcgagatcggcaagctgccccagcacctgacgctccgggcccagaacgccctggacaacctggtgatgctccacaactccgagcagggcgggaaggcgtaccgccacgccatggaggagctgcccgacaccatcgagaccctgatgctcctggccctgatcgccgtgctcaccgggggcgtcacgctgttcttcctgagcgggaagggcctcggcaagacctccatcgggctgctgtgcgtgaccgcgagctccgccctcctgtggatggccagcgtggagccccactggatcgccgcctccatcatcctggagttcttcctcatggtcctgctgatcccggagcccgaccggcagcgcacgccccaggacaaccagctcgcgtacgtggtgatcggcctgctgttcatgatcctcacggtcgccgccaacgagatggggctgctggagaccaccaagaaggacctcggcatcgggcacgtggccgccgagaaccaccagcacgcgaccatgctggacgtggacctgcacccggccagcgcctggacgctctacgccgtcgccaccaccgtgatcacccccatgatgcggcacacgatcgagaacaccaccgcgaacatctccctgaccgccatcgccaaccaggccgccatcctgatgggcctcgacaagggctggcccatcagcaagatggacctgggggtgcccctgctcgcgctgggctgctactcccaggtcaacccgctgacgctcaccgccgccgtgctgatgctggtggcccactacgcgatcatcgggcccggcctccaggccaaggccacccgcgaggcccagaagcggaccgccgcggggatcatgaagaaccccacggtcgacggcatcgtggccatcgacctggaccccgtggtctacgacgccaagttcgagaagcagctgggccagatcatgctcctgatcctgtgcaccagccagatcctcctgatgcgcaccacctgggccctgtgcgagtccatcacgctcgccaccgggccgctgaccaccctgtgggagggcagccccgggaagttctggaacacgaccatcgcggtgtccatggccaacatcttccgcggcagctacctcgccggcgccgggctggccttctccctgatgaagtccctcggcgggggccggcgcgggaccggcgcgcagggcgagaccctgggggagaagtggaagcggcagctgaaccagctctccaagagcgagttcaacacgtacaagcgcagcggcatcatggaggtggaccggtccgaggccaaggaggggctgaagcgcggcgagaccaccaagcacgccgtcagccgggggaccgccaagctgcgctggttcgtggagcggaacctggtgaagcccgagggcaaggtcatcgacctcggctgcgggcgcggcgggtggtcctactactgcgcgggcctgaagaaggtgaccgaggtgaaggggtacacgaagggcggccccgggcacgaggagccgatccccatggccacctacggctggaacctggtcaagctccacagcgggaaggacgtgttcttcatgccgcccgagaagtgcgacaccctgctgtgcgacatcggcgagtccagcccgaaccccaccatcgaggaggggcggacgctccgcgtgctgaagatggtcgagccctggctgcggggcaaccagttctgcatcaagatcctcaacccctacatgccgtccgtggtggagaccctggagcagatgcagcgcaagcacggcgggatgctggtccggaaccccctcagccgcaactccacccacgagatgtactgggtgagctgcggcaccgggaacatcgtgtccgccgtcaacatgacgagccggatgctgctgaaccgcttcaccatggcccaccggaagcccacctacgagcgcgacgtggacctcggcgccggcacccgccacgtggcggtcgagcccgaggtggccaacctggacatcatcgggcagcggatcgagaacatcaagaacgagcacaagtccacgtggcactacgacgaggacaacccgtacaagacctgggcctaccacggcagctacgaggtgaagccctccgggagcgcctccagcatggtcaacggcgtggtccgcctgctcaccaagccctgggacgtgatccccatggtgacccagatcgccatgacggacaccaccccgttcgggcagcagcgggtcttcaaggagaaggtggacacccgcacgccccgggcgaagcgcggcaccgcccagatcatggaggtgaccgccaagtggctgtggggcttcctgtcccggaacaagaagccccgcatctgcacccgggaggagttcacgcgcaaggtccggagcaacgccgccatcggggcggtgttcgtggacgagaaccagtggaacagcgccaaggaggccgtcgaggacgagcgcttctgggacctcgtgcaccgggagcgcgagctgcacaagcagggcaagtgcgcgacctgcgtgtacaacatgatggggaagcgggagaagaagctgggcgagttcgggaaggcgaagggctcccgcgccatctggtacatgtggctcggcgcccggttcctggagttcgaggccctggggttcatgaacgaggaccactggttcagccgcgagaactccctcagcggcgtcgagggggagggcctgcacaagctggggtacatcctccgggacatctccaagatcccgggcggcaacatgtacgccgacgacaccgcggggtgggacacccgcatcacggaggacgacctgcagaacgaggccaagatcaccgacatcatggagcccgagcacgccctgctcgccaccagcatcttcaagctgacctaccagaacaaggtggtgcgggtccagcgccccgccaagaacggcacggtgatggacgtgatctcccgccgggaccagcgcgggagcggccaggtcggcacctacgggctgaacaccttcaccaacatggaggtgcagctcatccggcagatggagtccgagggcatcttcttccccagcgagctggagtccccgaacctggcggagcgcgtgctcgactggctggagaagcacggggccgagcggctgaagcgcatggccatcagcggcgacgactgcgtcgtgaagcccatcgacgaccggttcgccacggccctcatcgcgctgaacgacatggggaaggtgcgcaaggacatcccccagtgggagccctccaagggctggaacgactggcagcaggtcccgttctgcagccaccacttccaccagctgatcatgaaggacggccgggagatcgtggtgccctgccgcaaccaggacgagctcgtcgggcgggcccgcgtgtcccagggcgccgggtggagcctgcgggagaccgcctgcctgggcaagtcctacgcccagatgtggcagctcatgtacttccaccgccgggacctgcgcctggcggccaacgccatctgcagcgccgtgcccgtcgactgggtgcccaccagccggaccacctggtccatccacgcgcaccaccagtggatgacgaccgaggacatgctcagcgtgtggaaccgcgtctggatcgaggagaacccgtggatggaggacaagacccacgtgtccagctgggaggaggtgccctacctggggaagcgggaggaccagtggtgcggctccctgatcggcctcaccgcccgcgccacgtgggccaccaacatccaggtcgccatcaaccaggtgcgccggctgatcgggaacgagaactacctggactacatgaccagcatgaagcgcttcaagaacgagtccgaccccgagggcgcgctctggtga

SEQ ID NO: 7930 - RNA, 9879 nt, synthetic construct
  misc_feature 1..9879: note = derived and/or modified CDS sequence (opt1) from DENV-1__JX669469__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgggacaagcggtccgtggccctggcgccccacgtgggcctggggctcgagacccgcaccgagacctggatgagctccgagggcgcctggaagcagatccagaaggtcgagacctgggccctgcggcacccggggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcaaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccgcctcatcaccgccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgcgagctgaagtgcgggtccggcatcttcgtcaccaacgaggtgcacacctggaccgagcagtacaagttccaggccgacagcccgaagcggctgagcgcggccatcggccgcgcctgggaggagggggtgtgcggcatccggtccgccacccgcctcgagaacatcatgtggaagcagatcagcaacgagctgaaccacatcctgctcgagaacgacatcaagttcacggtcgtggtggggaacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacgagcagcgcgcctggaacatctgggaggtcgaggactacggcttcgggatcttcacgaccaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatgtacgggggcccgatctcccagcacaactaccgccccgggtacttcacccagaccgccggcccctggcacctggggaagctcgagctggacttcgacctgtgcgagggcacgaccgtggtggtcgacgagcactgcggcagccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtccggtccatggtgagcgccggcagcggcgaggtggactccttcagcctggggatcctgtgcgtctccatcatgatcgaggaggtgatgcgcagccggtggtcccgcaagatgctcatgaccggcacgctggccgtgttcctgctcctgatcatggcccagctgacctggaacgacctcatccgcctgtgcatcatggtcggggcgaacgccagcgacaagatgggcatggggaccacctacctggccctcatggccacgttcaagatgcggccgatgttcgccgtggggctgctgttccgccggctcacctcccgcgaggtgctgctgctcaccatcggcctgagcctggtcgcgtccgtggagctccccaacagcctggaggagctgggggacggcctcgccatggggatcatgatgctgaagctgctcaccgagttccagccccaccagctgtggacgaccctgctctccctgaccttcatcaagaccacgctgagcctcgactacgcctggaagaccaccgccatggtcctgtccatcgtgagcctgttccccctctgcctgtccaccacgagccagaagaccacctggctgccggtgctcctgggctccttcggctgcaagcccctgaccatgttcctcatcaccgagaacgagatctgggggcgcaagagctggcccctgaacgagggcatcatggcgatcgggatcgtctccatcctgctcagcagcctgctgaagaacgacgtgcccctcgccggcccgctgatcgccgggggcatgctgatcgcctgctacgtgatctccggcagctccgccgacctcagcctggagaaggcggccgaggtctcctgggaggaggaggccgagcacagcgggacgtcccacaacatcctggtggaggtgcaggacgacggcaccatgaagatcaaggacgaggagcgcgacgacaccctcaccatcctgctgaaggccacgctcctggccgtcagcggggtgtaccccatgtccatccccgcgaccctgttcgtgtggtacttctggcagaagaagaagcagcggagcggcgtcctctgggacaccccctccccgcccgaggtggagcgcgccgtgctggacgacgggatctaccggatcctgcagcgcggcctgctcggccggagccaggtcggggtgggcgtgttccaggacggggtcttccacaccatgtggcacgtgacgcgcggcgccgtgctgatgtaccaggggaagcggctggagccctcctgggccagcgtcaagaaggacctcatctcctacggcggcgggtggcgcttccagggcagctggaacaccggggaggaggtccaggtgatcgccgtcgagcccggcaagaacccgaagaacgtgcagaccacccccgggacgttcaagacccccgagggcgaggtgggcgcgatcgccctggacttcaagcccgggacctccggcagcccgatcgtcaaccgggaggggaagatcgtgggcctgtacggcaacggggtggtcaccacgtccggcacctacgtgagcgccatcgcccaggccaaggcgagccaggaggggcccctccccgagatcgaggacgaggtgttcaagaagcgcaacctgaccatcatggacctgcacccgggctccgggaagacccggcgctacctccccgccatcgtccgggaggccatcaagcgcaagctgcggacgctgatcctcgcccccacccgcgtggtggcgagcgagatggccgaggccctgaagggcatgcccatccgctaccagaccaccgccgtcaagtccgagcacacgggccgggagatcgtggacctgatgtgccacgccaccttcaccatgcgcctcctgagcccggtgcgggtccccaactacaacatgatcatcatggacgaggcgcacttcaccgaccccgcctccatcgccgcccgcgggtacatcagcacgcgggtgggcatgggggaggccgcggccatcttcatgaccgccacgccgcccggctccgtggaggccttcccccagagcaacgccgtcatccaggacgaggagcgcgacatccccgagcggtcctggaacagcgggtacgactggatcaccgacttccccggcaagacggtgtggttcgtgccctccatcaagagcggcaacgacatcgcgaactgcctgcgcaagaacgggaagcgggtcatccagctctcccgcaagaccttcgacaccgagtaccagaagaccaagaacaacgactgggactacgtggtgacgaccgacatcagcgagatgggcgccaacttccgggccgaccgcgtcatcgacccccggcgctgcctgaagcccgtgatcctgaaggacgggcccgagcgggtgatcctcgccggcccgatgcccgtcaccgtggcgtccgccgcccagcgccgggggcgcatcggccggaaccagaacaaggagggcgaccagtacgtctacatggggcagcccctgaacaacgacgaggaccacgcccactggaccgaggccaagatgctgctcgacaacatcaacacgcccgagggcatcatcccggcgctgttcgagcccgagcgcgagaagtccgccgccatcgacggggagtaccgcctgcggggcgaggcccgcaagaccttcgtggagctcatgcggcgcggggacctgcccgtgtggctgtcctacaaggtcgccagcgagggcttccagtactccgaccggcgctggtgcttcgacggcgagcggaacaaccaggtgctcgaggagaacatggacgtggagatctggaccaaggagggggagcgcaagaagctgcggccccgctggctggacgcgcggacctacagcgacccgctcgccctgcgcgagttcaaggagttcgccgccggccggcgcagcgtctccggggacctgatcctcgagatcggcaagctgccccagcacctgaccctccgggcccagaacgcgctggacaacctggtgatgctccacaacagcgagcagggcgggaaggcctaccgccacgccatggaggagctgcccgacacgatcgagaccctgatgctcctggccctgatcgcggtgctcaccggcggggtcaccctgttcttcctgtccggcaaggggctcggcaagacgagcatcggcctgctgtgcgtgaccgcctccagcgccctcctgtggatggcctccgtggagccccactggatcgccgcgagcatcatcctggagttcttcctcatggtcctgctgatcccggagcccgaccggcagcgcacgccccaggacaaccagctcgcctacgtggtgatcgggctgctgttcatgatcctcaccgtcgccgccaacgagatgggcctgctggagacgaccaagaaggacctcgggatcggccacgtggccgcggagaaccaccagcacgccaccatcctggacgtggacctgcacccggcctccgcctggaccctctacgccgtcgcgacgaccgtgatcacccccatgatgcggcacaccatcgagaacacgaccgccaacatcagcctgaccgccatcgccaaccaggccgcgatcctgatggggctcgacaagggctggcccatctccaagatggacctgggcgtgcccctgctcgccctggggtgctacagccaggtcaacccgctgaccctcacggccgccgtgctgatgctggtggcgcactacgccatcatcggccccgggctccaggccaaggccacccgcgaggcccagaagcggaccgcggccggcatcatgaagaaccccaccgtcgacgggatcgtggccatcgacctggaccccgtggtctacgacgccaagttcgagaagcagctgggccagatcatgctcctgatcctgtgcacgtcccagatcctcctgatgcgcaccacctgggccctgtgcgagagcatcaccctcgcgacgggcccgctgaccaccctgtgggaggggtcccccggcaagttctggaacaccacgatcgccgtgagcatggccaacatcttccgcgggtcctacctcgccggcgccggcctggcgttcagcctgatgaagtccctcgggggcgggcggcgcggcaccggggcccagggcgagaccctgggcgagaagtggaagcggcagctgaaccagctcagcaagagcgagttcaacacctacaagcgctccgggatcatggaggtggaccggagcgaggccaaggagggcctgaagcgcggggagacgaccaagcacgccgtctcccggggcaccgcgaagctgcgctggttcgtggagcggaacctggtgaagcccgaggggaaggtcatcgacctcggctgcggccgcgggggctggagctactactgcgccgggctgaagaaggtgaccgaggtgaagggctacaccaagggcgggcccggccacgaggagccgatccccatggccacgtacgggtggaacctggtcaagctccactccggcaaggacgtgttcttcatgccgcccgagaagtgcgacaccctgctgtgcgacatcggggagagctccccgaaccccaccatcgaggagggccggaccctccgcgtgctgaagatggtcgagccctggctgcgggggaaccagttctgcatcaagatcctcaacccctacatgccgagcgtggtggagacgctggagcagatgcagcgcaagcacggcggcatgctggtccggaaccccctctcccgcaacagcacccacgagatgtactgggtgtcctgcgggaccggcaacatcgtgagcgccgtcaacatgacctcccggatgctgctgaaccgcttcacgatggcccaccggaagcccacctacgagcgcgacgtggacctcggggcgggcacccgccacgtggccgtcgagcccgaggtggccaacctggacatcatcggccagcggatcgagaacatcaagaacgagcacaagagcacctggcactacgacgaggacaacccgtacaagacgtgggcctaccacgggtcctacgaggtgaagcccagcggctccgccagctccatggtcaacggggtggtccgcctgctcaccaagccctgggacgtgatccccatggtgacccagatcgcgatgaccgacacgaccccgttcggccagcagcgggtcttcaaggagaaggtggacacccgcacgccccgggccaagcgcgggacggcccagatcatggaggtgaccgccaagtggctgtggggcttcctgagccggaacaagaagccccgcatctgcacccgggaggagttcacccgcaaggtccggagcaacgccgcgatcggcgccgtgttcgtggacgagaaccagtggaactccgccaaggaggccgtcgaggacgagcgcttctgggacctcgtgcaccgggagcgcgagctgcacaagcaggggaagtgcgcgacgtgcgtgtacaacatgatgggcaagcgggagaagaagctgggggagttcggcaaggccaaggggagccgcgccatctggtacatgtggctcggcgcccggttcctggagttcgaggccctgggcttcatgaacgaggaccactggttctcccgcgagaacagcctctccggggtcgagggcgaggggctgcacaagctgggctacatcctccgggacatcagcaagatccccggcgggaacatgtacgcggacgacaccgccgggtgggacacccgcatcaccgaggacgacctgcagaacgaggccaagatcacggacatcatggagcccgagcacgccctgctcgccacctccatcttcaagctgacctaccagaacaaggtggtgcgggtccagcgccccgcgaagaacgggaccgtgatggacgtgatcagccgccgggaccagcgcggctccgggcaggtcggcacgtacggcctgaacaccttcaccaacatggaggtgcagctcatccggcagatggagagcgaggggatcttcttcccctccgagctggagagcccgaacctggccgagcgcgtgctcgactggctggagaagcacggcgccgagcggctgaagcgcatggccatctccggggacgactgcgtcgtgaagcccatcgacgaccggttcgccaccgcgctcatcgccctgaacgacatgggcaaggtgcgcaaggacatcccccagtgggagcccagcaaggggtggaacgactggcagcaggtcccgttctgctcccaccacttccaccagctgatcatgaaggacggccgggagatcgtggtgccctgccgcaaccaggacgagctcgtcggccgggcccgcgtgagccagggggccggctggtccctgcgggagacggcctgcctgggcaagagctacgcgcagatgtggcagctcatgtacttccaccgccgggacctgcgcctggccgccaacgccatctgcagcgcggtgcccgtcgactgggtgcccacctcccggaccacctggagcatccacgcccaccaccagtggatgaccacggaggacatgctctccgtgtggaaccgcgtctggatcgaggagaacccgtggatggaggacaagacccacgtgagctcctgggaggaggtgccctacctgggcaagcgggaggaccagtggtgcgggagcctgatcggcctcaccgcccgcgccacctgggccacgaacatccaggtcgcgatcaaccaggtgcgccggctgatcggcaacgagaactacctggactacatgacctccatgaagcgcttcaagaacgagagcgaccccgagggggccctctggtga

SEQ ID NO: 7931 - RNA, 9879 nt, synthetic construct
  misc_feature 1..9879: note = derived and/or modified CDS sequence (opt1) from DENV-1__JX669470__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgggacaagcggtccgtggccctggcgccccacgtgggcctggggctcgagacccggaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgtggtggggatggtcaccctgtacctcggcgtgatggtgcaggccgacagcgggtgcgtcatcaactggaagggccgcgagctgaagtgcgggtccggcatcttcgtgacgaacgaggtgcacacctggaccgagcagtacaagttccaggccgacagcccgaagcggctgagcgccgcgatcggccgcgcctgggaggagggggtctgcggcatccggtccgccacccgcctcgagaacatcatgtggaagcagatcagcaacgagctgaaccacatcctgctcgagaacgacatcaagttcaccgtggtggtcgggaacgccaacggcatcctggcccaggggaagaagatgatccggccccagcccatggagcacaagtactcctggaagtcctggggcaaggcgaagatcatcggcgccgacatccagaacacgaccttcatcatcgacgggcccgacaccccggagtgccccgacgagcagcgcgcctggaacatctgggaggtggaggactacggcttcgggatcttcaccacgaacatctggctgaagctccgggactcctacacccagatgtgcgaccaccgcctgatgagcgccgcgatcaaggactccaaggccgtgcacgccgacatgggctactggatcgagagcgagaagaacgagacctggaagctggcccgggcctccttcatcgaggtcaagacctgcatctggcccaagagccacacgctctggtccaacggcgtgctggagagcgagatgatcatccccaagatgtacgggggcccgatctcccagcacaactaccgccccgggtacttcacccagaccgcgggcccctggcacctggggaagctcgagctggacttcgacctgtgcgagggcaccacggtggtcgtggacgagcactgcggcagccgggggccgtccctccgcaccaccaccgtgacgggcaagatcatccacgagtggtgctgccggagctgcaccctgccgcccctgcgcttccgcggggaggacggctgctggtacgggatggagatccgccccgtcaaggagaaggaggagaacctcgtgcggtccatggtgagcgccggcagcggcgaggtcgactccttcagcctggggatcctgtgcgtgtccatcatgatcgaggaggtgatgcgcagccggtggtcccgcaagatgctcatgaccggcaccctggccgtcttcctgctcctgatcatggggcagctgacgtggaacgacctcatccgcctgtgcatcatggtgggcgccaacgccagcgacaagatggggatgggcaccacctacctggcgctcatggccaccttcaagatgcggccgatgttcgccgtggggctgctgttccgccggctcacgtcccgcgaggtcctgctgctcaccatcgggctgagcctggtggcctccgtcgagctccccaacagcctggaggagctgggcgacgggctcgccatgggcatcatgatgctgaagctgctcaccgagttccagccccaccagctgtggaccacgctgctctccctgaccttcatcaagaccaccctgagcctcgactacgcgtggaagacgaccgccatggtgctgtccatcgtgagcctgttccccctctgcctgtccaccaccagccagaagacgacctggctgccggtcctcctgggctccttcgggtgcaagcccctgaccatgttcctcatcaccgagaacgagatctggggccgcaagagctggcccctgaacgaggggatcatggccgtgggcatcgtgtccatcctgctcagcagcctgctgaagaacgacgtccccctcgccgggccgctgatcgcgggcggcatgctgatcgcctgctacgtgatctccgggagctccgccgacctcagcctggagaaggccgccgaggtgtcctgggaggaggaggcggagcacagcggcacctcccacaacatcctggtcgaggtgcaggacgacgggacgatgaagatcaaggacgaggagcgcgacgacaccctcaccatcctgctgaaggccaccctcctggccgtgagcggcgtctaccccatgtccatccccgccacgctgttcgtgtggtacctctggcagaagaagaagcagcggagcggggtgctgtgggacaccccctccccgcccgaggtcgagcgcgccgtgctggacgacggcatctaccggatcctgcagcgcggcctcctggggcggagccaggtgggcgtcggggtgttccaggacggcgtgttccacaccatgtggcacgtcacccgcggggcggtgctgatgtaccagggcaagcggctcgagccctcctgggccagcgtgaagaaggacctgatctcctacggcgggggctggcgcttccaggggagctggaacacgggcgaggaggtccaggtgatcgccgtggagcccgggaagaacccgaagaacgtccagaccacccccggcaccttcaagacgcccgagggcgaggtgggggccatcgccctggacttcaagcccggcacctccgggagcccgatcgtgaaccgggagggcaagatcgtcggcctctacgggaacggcgtggtgaccacctccgggacgtacgtcagcgcgatcgcccaggccaaggccagccaggagggccccctgcccgagatcgaggacgaggtgttcaagaagcgcaacctgaccatcatggacctccacccggggtccggcaagacccggcgctacctgcccgccatcgtgcgggaggcgatcaagcgcaagctgcggaccctcatcctggcccccacgcgcgtcgtggccagcgagatggccgaggcgctgaagggcatgcccatccgctaccagaccaccgccgtgaagtccgagcacaccgggcgggagatcgtcgacctcatgtgccacgccacgttcaccatgcgcctgctgagcccggtgcgggtgcccaactacaacatgatcatcatggacgaggcccacttcaccgaccccgcctccatcgcggcccgcggctacatcagcacccgggtcgggatgggcgaggccgccgccatcttcatgacggcgacgccgcccgggtccgtggaggccttcccccagagcaacgccgtgatccaggacgaggagcgcgacatccccgagcggtcctggaacagcggctacgactggatcaccgacttccccggcaagaccgtctggttcgtgccctccatcaagagcgggaacgacatcgccaactgcctccgcaagaacggcaagcgggtgatccagctgtcccgcaagacgttcgacaccgagtaccagaagaccaagaacaacgactgggactacgtcgtgaccacggacatcagcgagatgggggccaacttccgggcggaccgcgtgatcgacccccggcgctgcctgaagcccgtcatcctcaaggacggccccgagcgggtgatcctggccgggccgatgcccgtcaccgtggcctccgccgcgcagcgccggggccgcatcggccggaaccagaacaaggagggggaccagtacgtgtacatgggccagcccctgaacaacgacgaggaccacgcccactggaccgaggccaagatgctcctggacaacatcaacacccccgaggggatcatcccggccctgttcgagcccgagcgcgagaagtccgccgcgatcgacggcgagtaccgcctccgcggggaggcccgcaagacgttcgtcgagctgatgcggcgcggcgacctgcccgtgtggctctcctacaaggtggccagcgagggcttccagtactccgaccggcgctggtgcttcgacggggagcggaacaaccaggtcctggaggagaacatggacgtggagatctggaccaaggagggcgagcgcaagaagctgcggccccgctggctcgacgcccggacctacagcgacccgctggccctgcgcgagttcaaggagttcgcggccgggcggcgcagcgtgtccggcgacctcatcctggagatcggcaagctgccccagcacctcaccctgcgggcccagaacgccctggacaacctcgtcatgctgcacaacagcgagcagggcgggaaggcctaccgccacgcgatggaggagctgcccgacaccatcgagacgctcatgctgctggccctcatcgccgtgctgaccgggggcgtgaccctgttcttcctctccgggaagggcctgggcaagaccagcatcgggctgctctgcgtcacggcctccagcgcgctgctgtggatggcctccgtggagccccactggatcgccgccagcatcatcctcgagttcttcctgatggtgctgctcatcccggagcccgaccggcagcgcacgccccaggacaaccagctggcctacgtcgtgatcggcctcctcttcatgatcctgaccgtggcggccaacgagatggggctgctcgagaccacgaagaaggacctgggcatcgggcacgtcgccgccgagaaccaccagcacgccaccatgctggacgtggacctccacccggcgtccgcctggaccctgtacgccgtggccaccacggtcatcacccccatgatgcggcacaccatcgagaacaccacggccaacatcagcctgaccgcgatcgccaaccaggccgccatcctcatgggcctggacaagggctggcccatctccaagatggacctgggggtgcccctcctggccctgggctgctacagccaggtgaacccgctcaccctgaccgcggccgtcctgatgctcgtggcccactacgccatcatcgggcccggcctgcaggcgaaggccacgcgcgaggcccagaagcggaccgccgccgggatcatgaagaaccccaccgtggacggcatcgtcgcgatcgacctggaccccgtggtgtacgacgccaagttcgagaagcagctcggccagatcatgctgctgatcctctgcacctcccagatcctgctgatgcgcacgacctgggccctctgcgagagcatcaccctggccaccgggccgctgacgaccctctgggagggctcccccgggaagttctggaacaccaccatcgccgtcagcatggcgaacatcttccgcggctcctacctggccggcgccgggctggccttcagcctcatgaagtccctgggcgggggccggcgcgggacgggcgcccagggcgagaccctgggggagaagtggaagcggcagctcaaccagctgagcaagagcgagttcaacacctacaagcgctccggcatcatggaggtggaccggagcgaggcgaaggaggggctgaagcgcggcgagaccacgaagcacgccgtgtcccgggggaccgccaagctgcgctggttcgtcgagcggaacctcgtgaagcccgagggcaaggtgatcgacctgggctgcgggcgcggcgggtggagctactactgcgccggcctgaagaaggtcaccgaggtgaaggggtacaccaagggcggccccgggcacgaggagccgatccccatggcgacctacggctggaacctcgtgaagctgcactccgggaaggacgtcttcttcatgccgcccgagaagtgcgacacgctgctctgcgacatcggcgagagctccccgaaccccaccatcgaggaggggcggaccctgcgcgtgctgaagatggtggagccctggctccggggcaaccagttctgcatcaagatcctgaacccctacatgccgagcgtcgtggagaccctggagcagatgcagcgcaagcacggcgggatgctcgtgcggaaccccctgtcccgcaacagcacgcacgagatgtactgggtctcctgcggcaccgggaacatcgtgagcgccgtgaacatgacctcccggatgctgctcaaccgcttcaccatggcccaccggaagcccacgtacgagcgcgacgtcgacctgggcgccggcacccgccacgtggccgtggagcccgaggtcgcgaacctggacatcatcgggcagcggatcgagaacatcaagaacgagcacaagagcacctggcactacgacgaggacaacccgtacaagacctgggcctaccacggctcctacgaggtgaagcccagcgggtccgccagctccatggtcaacggcgtggtgcgcctcctgacgaagccctgggacgtcatccccatggtgacccagatcgccatgaccgacaccacgccgttcgggcagcagcgggtgttcaaggagaaggtcgacacccgcacgccccgggccaagcgcggcaccgcgcagatcatggaggtgacggccaagtggctgtggggcttcctcagccggaacaagaagccccgcatctgcacccgggaggagttcacccgcaaggtgcggagcaacgccgccatcggggccgtcttcgtggacgagaaccagtggaactccgcgaaggaggccgtggaggacgagcgcttctgggacctggtccaccgggagcgcgagctgcacaagcagggcaagtgcgcgacctgcgtgtacaacatgatggggaagcgggagaagaagctcggcgagttcgggaaggccaagggcagccgcgcgatctggtacatgtggctgggcgcccggttcctggagttcgaggccctcgggttcatgaacgaggaccactggttctcccgcgagaacagcctgtccggcgtggagggggagggcctgcacaagctcgggtacatcctgcgggacatcagcaagatcccgggcggcaacatgtacgccgacgacacggccgggtgggacacccgcatcaccgaggacgacctgcggaacgaggcgaagatcaccgacatcatggagcccgagcacgccctcctggccacgtccatcttcaagctgacctaccagaacaaggtcgtgcgcgtgcagcgccccgccaagaacggcaccgtcatggacgtgatcagccggcgcgaccagcgggggtccggccaggtgggcacctacgggctcaacacgttcaccaacatggaggtccagctgatccgccagatggagagcgagggcatcttcttcccctccgagctggagagcccgaacctcgccgagcgggtgctggactggctggagaagcacggggcggagcgcctcaagcggatggccatctccggcgacgactgcgtggtcaagcccatcgacgaccgcttcgccaccgccctgatcgccctgaacgacatggggaaggtgcggaaggacatcccccagtgggagcccagcaagggctggaacgactggcagcaggtcccgttctgctcccaccacttccaccagctcatcatgaaggacggccgcgagatcgtcgtgccctgccggaaccaggacgagctggtggggcgcgcgcgggtcagccagggcgccgggtggtccctgcgcgagaccgcctgcctcggcaagagctacgcccagatgtggcagctgatgtacttccaccggcgcgacctgcggctcgccgcgaacgccatctgcagcgccgtgcccgtggactgggtccccacgtcccgcaccacctggagcatccacgcccaccaccagtggatgaccaccgaggacatgctgtccgtgtggaaccgggtgtggatcgaggagaacccgtggatggaggacaagacgcacgtcagctcctgggaggaggtgccctacctggggaagcgcgaggaccagtggtgcggcagcctcatcggcctgaccgcgcgcgccacctgggccaccaacatccaggtggccatcaaccaggtccggcgcctgatcgggaacgagaactacctcgactacatgacgtccatgaagcggttcaagaacgagagcgaccccgagggcgccctgtggtga

SEQ ID NO: 7932 - RNA, 9879 nt, synthetic construct
  misc_feature 1..9879: note = derived and/or modified CDS sequence (opt1) from DENV-1__JX669471__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgggacaagcggtccgtggccctggcgccccacgtgggcctggggctcgagacccggaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccgcctcatcaccgccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgcgagctgaagtgcgggtccggcatcttcgtcaccaacgaggtgcacacctggaccgagcagtacaagttccaggccgacagcccgaagcggctgagcgcggccatcggccgcgcctgggaggagggggtgtgcggcatccggtccgccacccgcctcgagaacatcatgtggaagcagatcagcaacgagctgaaccacatcctgctcgagaacgacatcaagttcacggtcgtggtggggaacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacgagcagcgcgcctggaacatctgggaggtcgaggactacggcttcgggatcttcacgaccaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacgtgcatctggcccaagagccacaccctctggtccaacggcgtcctggagagcgagatgatcatccccaagatgtacgggggcccgatctcccagcacaactaccgccccgggtacttcacccagaccgccggcccctggcacctggggaagctcgagctggacttcgacctgtgcgagggcacgaccgtggtggtcgacgagcactgcggcagccgggggccgtccctccgcaccaccacggtgaccggcaagatcatccacgagtggtgctgccggagctgcaccctgccgcccctgcgcttccgcggggaggacggctgctggtacgggatggagatccgccccgtgaaggagaaggaggagaacctcgtccggtccatggtgagcgccggcagcggcgaggtggactccttcagcctggggatcctgtgcgtctccatcatgatcgaggaggtgatgcgcagccggtggtcccgcaagatgctcatgaccggcacgctggccgtgttcctgctcctgatcatggggcagctgacctggaacgacctcatccgcctgtgcatcatggtcggcgccaacgcgagcgacaagatggggatgggcaccacctacctggccctcatggccacgctgaagatgcggccgatgttcgccgtggggctcctcttccgccggctgacctcccgcgaggtgctgctcctgaccatcgggctgagcctcgtcgcctccgtggagctgcccaacagcctggaggagctcggcgacgggctggcgatgggcatcatgatgctgaagctcctgaccgagttccagccccaccagctgtggacgaccctcctgtccctgaccttcatcaagaccacgctcagcctggactacgcctggaagaccaccgccatggtcctgtccatcgtgagcctcttccccctgtgcctgtccaccacgagccagaagaccacctggctcccggtgctgctgggctccttcgggtgcaagcccctcaccatgttcctgatcaccgagaacgagatctggggccgcaagagctggcccctgaacgaggggatcatggccatcggcatcgtctccatcctcctgagcagcctgctcaagaacgacgtgcccctggcggggccgctgatcgccggcggcatgctcatcgcctgctacgtgatctccgggagctccgccgacctgagcctggagaaggccgcggaggtctcctgggaggaggaggccgagcacagcggcacgtcccacaacatcctcgtggaggtgcaggacgacgggaccatgaagatcaaggacgaggagcgcgacgacaccctgaccatcctgctcaaggccacgctgctggccgtcagcggcgtgtaccccatgtccatccccgccaccctcttcgtgtggtacttctggcagaagaagaagcagcggagcggggtcctgtgggacaccccctccccgcccgaggtggagcgcgcggtgctggacgacggcatctaccggatcctgcagcgcggcctcctggggcggagccaggtcggcgtgggggtgttccaggacggcgtcttccacaccatgtggcacgtgacgcgcggggccgtgctgatgtaccagggcaagcggctcgagccctcctgggccagcgtcaagaaggacctgatctcctacggcgggggctggcgcttccaggggagctggaacaccggcgaggaggtccaggtgatcgccgtcgagcccgggaagaacccgaagaacgtgcagaccacccccggcacgttcaagacccccgagggcgaggtgggggccatcgcgctggacttcaagcccggcacctccgggagcccgatcgtcaaccgggagggcaagatcgtgggcctctacgggaacggcgtggtcaccacgtccgggacctacgtgagcgccatcgcccaggccaaggccagccaggagggccccctgcccgagatcgaggacgaggtgttcaagaagcgcaacctgaccatcatggacctccacccggggtccggcaagacccggcgctacctgcccgcgatcgtccgggaggccatcaagcgcaagctgcggacgctcatcctggcccccacccgcgtggtggccagcgagatggcggaggccctgaagggcatgcccatccgctaccagaccaccgccgtcaagtccgagcacacggggcgggagatcgtggacctcatgtgccacgccaccttcaccatgcgcctgctgagcccggtgcgggtccccaactacaacatgatcatcatggacgaggcccacttcaccgtgcccgcgtccatcgccgcccgcggctacatcagcacgcgggtggggatgggcgaggccgccgcgatcttcatgaccgccacgccgcccgggtccgtcgaggccttcccccagagcaacgccgtgatccaggacgaggagcgcgacatccccgagcggtcctggaacagcggctacgactggatcaccgacttccccggcaagacggtgtggttcgtcccctccatcaagagcgggaacgacatcgccaactgcctccgcaagaacggcaagcgggtgatccagctgtcccgcaagaccttcgacaccgagtaccagaagaccaagaacaacgactgggactacgtggtcacgaccgacatcagcgagatgggggcgaacttccgggccgaccgcgtgatcgacccccggcgctgcctgaagcccgtgatcctcaaggacggccccgagcgggtcatcctggccgggccgatgcccgtgaccgtcgcctccgcggcccagcgccggggccgcatcggccggaaccagaacaaggagggggaccagtacgtgtacatgggccagcccctgaacaacgacgaggaccacgcccactggaccgaggccaagatgctcctggacaacatcaacacgcccgaggggatcatcccggccctgttcgagcccgagcgcgagaagtccgcggccatcgacggcgagtaccgcctccgcggggaggcccgcaagaccttcgtggagctgatgcggcgcggcgacctgcccgtctggctctcctacaaggtggccagcgagggcttccagtactccgaccggcgctggtgcttcgacggggagcggaacaaccaggtgctggaggagaacatggacgtcgagatctggaccaaggagggcgagcgcaagaagctgcggccccgctggctcgacgcccggacctacagcgacccgctggcgctgcgcgagttcaaggagttcgccgccgggcggcgcagcgtgtccggcgacctcatcctggagatcggcaagctgccccagcacctcacccagcgggcccagaacgccctggacaacctggtgatgctccacaacagcgagcagggcgggaaggcgtaccgccacgccatggaggagctgcccgacacgatcgagaccctgatgctcctggccctgatcgccgtcctcaccgggggcgtgaccctgttcttcctgtccgggaagggcctcggcaagacgagcatcgggctgctgtgcgtgaccgcgtccagcgccctcctgtggatggcctccgtcgagccccactggatcgccgccagcatcatcctggagttcttcctcatggtgctgctgatcccggagcccgaccggcagcgcacgccccaggacaaccagctcgcgtacgtggtcatcggcctgctgttcatgatcctcaccgtggccgccaacgagatggggctgctggagacgaccaagaaggacctcggcatcgggcacgtggccgccgagaaccaccagcacgcgaccatgctggacgtcgacctgcacccggcctccgcctggaccctctacgccgtggccacgaccgtgatcacccccatgatgcggcacaccatcgagaacacgaccgcgaacatcagcctgaccgccatcgccaaccaggccgccatcctgatgggcctcgacaagggctggcccatctccaagatggacctgggggtccccctgctcgcgctgggctgctacagccaggtgaacccgctgaccctcacggccgccgtgctgatgctggtcgcccactacgcgatcatcgggcccggcctccaggccaaggccacccgcgaggcccagaagcggaccgccgcggggatcatgaagaaccccaccgtggacggcatcgtggccatcgacctggaccccgtcgtgtacgacgccaagttcgagaagcagctgggccagatcatgctcctgatcctgtgcacgtcccagatcctcctgatgcgcaccacctgggccctgtgcgagagcatcaccctcgccacggggccgctgaccaccctgtgggagggctcccccgggaagttctggaacaccacgatcgcggtgagcatggccaacatcttccgcggctcctacctcgccggcgccgggctggccttcagcctgatgaagtccctcggcgggggccggcgcgggaccggcgcgcagggcgagaccctgggggagaagtggaagcggcagctgaaccagctcagcaagagcgagttcaacacctacaagcgctccggcatcatggaggtcgaccggagcgaggccaaggaggggctgaagcgcggcgagacgaccaagcacgccgtgtcccgggggaccgccaagctgcgctggttcgtggagcggaacctggtcaagcccgagggcaaggtgatcgacctcggctgcgggcgcggcgggtggagctactactgcgcgggcctgaagaaggtgaccgaggtcaaggggtacaccaagggcggccccgggcacgaggagccgatccccatggccacgtacggctggaacctggtgaagctccactccgggaaggacgtgttcttcatgccgcccgagaagtgcgacaccctgctgtgcgacatcggcgagagctccccgaaccccaccatcgaggaggggcggaccctccgcgtcctgaagatggtggagccctggctgcggggcaaccagttctgcatcaagatcctcaacccctacatgccgagcgtggtcgagacgctggagcagatgcagcgcaagcacggcgggatgctggtgcggaaccccctctcccgcaacagcacccacgagatgtactgggtgtcctgcggcaccgggaacatcgtcagcgccgtgaacatgacctcccggatgctgctgaaccgcttcacgatggcccaccggaagcccacctacgaccgcgacgtggacctcggcgccggcacccgccacgtcgcggtggagcccgaggtggccaacctggacatcatcgggcagcggatcgagaacatcaagaacgagcacaagagcacctggcactacgacgaggacaacccgtacaagacgtgggcctaccacggctcctacgaggtcaagcccagcgggtccgccagctccatggtgaacggcgtcgtgcgcctgctcaccaagccctgggacgtgatccccatggtcacccagatcgccatgaccgacacgaccccgttcgggcagcagcgggtgttcaaggagaaggtggacacccgcacgccccgggcgaagcgcggcacggcccagatcatggaggtcaccgccaagtggctgtggggcttcctgagccggaacaagaagccccgcatctgcacccgggaggagttcacccgcaaggtgcggagcaacgccgccatcggggcggtgttcgtcgacgagaaccagtggaactccgccaaggaggccgtggaggacgagcgcttctgggacctcgtgcaccgggagcgcgagctgcacaagcagggcaagtgcgccacgtgcgtctacaacatgatggggaagcgggagaagaagctgggcgagttcgggaaggcgaagggcagccgcgccatctggtacatgtggctcggcgcccggttcctggagttcgaggccctggggttcatgaacgaggaccactggttctcccgcgagaacagcctctccggcgtggagggggagggcctgcacaagctggggtacatcctccgggacatcagcaagatcccgggcggcaacatgtacgccgacgacaccgcggggtgggacacccgcatcaccgaggacgacctgcagaacgaggccaagatcacggacatcatggagcccgagcacgccctgctcgccacctccatcttcaagctgacctaccagaacaaggtggtccgggtgcagcgccccgccaagaacggcaccgtgatggacgtcatcagccgccgggaccagcgcgggtccggccaggtgggcacgtacgggctgaacaccttcaccaacatggaggtgcagctcatccggcagatggagagcgagggcatcttcttcccctccgagctggagagcccgaacctggcggagcgcgtcctcgactggctggagaagcacggggccgagcggctgaagcgcatggccatctccggcgacgactgcgtggtgaagcccatcgacgaccggttcgccaccgccctcatcgcgctgaacgacatggggaaggtccgcaaggacatcccccagtgggagcccagcaagggctggaacgactggcagcaggtcccgttctgctcccaccacttccaccagctgatcatgaaggacggccgggagatcgtggtcccctgccgcaaccaggacgagctcgtggggcgggcccgcgtgagccagggcgccgggtggtccctgcgggagacggcctgcctgggcaagagctacgcccagatgtggcagctcatgtacttccaccgccgggacctgcgcctggcggccaacgccatctgcagcgccgtccccgtggactgggtgcccacctcccggaccacctggagcatccacgcgcaccaccagtggatgaccacggaggacatgctctccgtctggaaccgcgtgtggatcgaggagaacccgtggatggaggacaagacccacgtgagctcctgggaggaggtcccctacctggggaagcgggaggaccagtggtgcggcagcctgatcggcctcaccgcccgcgccacctgggccacgaacatccaggtggccatcaaccaggtgcgccggctgatcgggaacgagaactacctggactacatgacctccatgaagcgcttcaagaacgagagcgaccccgagggcgcgctctggtga

SEQ ID NO: 7933 - RNA, 9879 nt, synthetic construct
  misc_feature 1..9879: note = derived and/or modified CDS sequence (opt1) from DENV-1__JX669472__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgccggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacgcgcaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccgcctcatcaccgccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgcgagctgaagtgcgggtccggcatcttcgtcaccaacgaggtgcacacctggaccgagcagtacaagttccaggccgacagcccgaagcggctgagcgcggccatcggccgcgcctgggaggagggggtgtgcggcatccggtccgccacccgcctcgagaacatcatgtggaagcagatcagcaacgagctgaaccacatcctgctcgagaacgacatgaagttcacggtcgtggtggggaacgccaacggcatcctggcgcaggggaagaagatgatcaagccccagcccatggagcacaagtactcctggaagtcctggggcaaggccaagatcatcggcgccgacatccagaacaccaccttcatcatcgacgggcccgacaccccggagtgccccgacgagcagcgggcctggaacatctgggaggtcgaggactacggcttcgggatcttcacgaccaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtgaagacgtgcatctggcccaagagccacaccctctggtccaacggcgtcctggagagcgagatgatcatccccaagatgtacgggggcccgatctcccagcacaactaccggcccgggtacttcacccagaccgccggcccctggcacctggggaagctcgagctggacttcgacctgtgcgagggcacgaccgtggtggtcgacgagcactgcggcagccgcgggccgtccctccggaccaccacggtgaccggcaagatcatccacgagtggtgctgccgcagctgcaccctgccgcccctgcggttccgcggggaggacggctgctggtacgggatggagatccggcccgtgaaggagaaggaggagaacctcgtccgctccatggtgagcgccggcagcggcgaggtggactccttcagcctggggatcctgtgcgtctccatcatgatcgaggaggtgatgcggagccgctggtcccggaagatgctcatgaccggcacgctggccgtgttcctgctcctgatcatggggcagctgacctggaacgacctcatccgcctgtgcatcatggtcggcgccaacgcgagcgacaagatggggatgggcaccacctacctggccctcatggccacgttcaagatgcgcccgatgttcgccgtggggctgctgttccggcgcctcacctcccgggaggtgctgctgctcaccatcgggctgagcctggtcgcctccgtggagctccccaacagcctggaggagctgggcgacgggctcgcgatgggcatcatgatgctgaagctgctcaccgagttccagccccaccagctgtggacgaccctgctctccctgaccttcatcaagaccacgctgagcctcgactacgcctggaagaccaccgccaccgtcctgtccatcgtgagcctgttccccctctgcctgtccacgaccagccagaagaccacctggctgccggtgctcctgggctccttcgggtgcaagcccctgaccatgttcctcatcacggagaacaagatctggggccgcaagagctggcccctgaacgaggggatcatggccatcggcatcgtctccatcctgctcagcagcctgctgaagaacgacgtgcccctcgcggggccgctgatcgccggcggcatgctgatcgcctgctacgtgatctccgggagctccgccgacctcagcctggagaaggccgcggaggtctcctgggaggaggaggccgagcacagcggcacctcccacaacatcctggtggaggtgcaggacgacgggaccatgaagatcaaggacgaggagcgggacgacaccctcacgatcctgctgaaggccaccctcctggccgtcagcggcgtgtaccccatgtccatccccgccaccctgttcgtgtggtacttctggcagaagaagaagcagcgcagcggggtcctctgggacaccccctccccgcccgaggtggagcgggcggtgctggacgacggcatctaccgcatcctgcagcggggcctgctcgggcgcagccaggtcggcgtgggggtgttccaggacggcgtcttccacacgatgtggcacgtgacccgcggggccgtgctgatgtaccagggcaagcgcctggagccctcctgggccagcgtcaagaaggacctcatctcctacggcgggggctggcggttccaggggagctggaacaccggcgaggaggtccaggtgatcgccgtcgagcccgggaagaacccgaagaacgtgcagaccacgcccggcaccttcaagacccccgagggcgaggtgggggccatcgcgctggacttcaagcccggcacctccgggagcccgatcgtcaaccgcgagggcaagatcgtgggcctgtacgggaacggcgtggtcacgacctccgggacctacgtgagcgccatcgcccaggccaaggccagccaggagggccccctccccgagatcgaggacgaggtgttcaagaagcggaacctgaccatcatggacctgcacccggggtccggcaagacgcgccggtacctccccgcgatcgtccgcgaggccatcaagcggaagctgcgcaccctgatcctcgcccccacccgggtggtggccagcgagatggcggaggccctgaagggcatgcccatccgctaccagaccacggccgtcaagtccgagcacaccgggcgcgagatcgtggacctgatgtgccacgccaccttcaccatgcggctcctgagcccggtgcgcgtccccaactacaacatgatcatcatggacgaggcccacttcacggaccccgcgtccatcgccgcccggggctacatcagcacccgcgtggggatgggcgaggccgccgcgatcttcatgaccgccacgccgcccgggtccgtggaggccttcccccagagcaacgccgtcatccaggacgaggagcgggacatccccgagcgctcctggaacagcggctacgactggatcacggacttccccggcaagaccgtgtggttcgtgccctccatcaagagcgggaacgacatcgccaactgcctgcggaagaacggcaagcgcgtcatccagctctcccggaagaccttcgacaccgagtaccagaagacgaagaacaacgactgggactacgtggtgaccaccgacatcagcgagatgggggcgaacttccgcgccgaccgggtcatcgacccccgccggtgcctgaagcccgtgatcctgaaggacggccccgagcgcgtgatcctcgccgggccgatgcccgtcaccgtggcctccgcggcccagcggcgcggccggatcggccgcaaccagaacaaggagggggaccagtacgtctacatgggccagcccctgaacaacgacgaggaccacgcccactggacggaggccaagatgctgctcgacaacatcaacacccccgaggggatcatcccggccctgttcgagcccgagcgggagaagtccgcggccatcgacggcgagtaccgcctgcgcggggaggcccggaagaccttcgtggagctcatgcgccggggcgacctgcccgtgtggctgtcctacaaggtcgccagcgagggcttccagtactccgaccgccggtggtgcttcgacggggagcgcaacaaccaggtgctcgaggagaacatggacgtggagatctggaccaaggagggcgagcggaagaagctgcgcccccggtggctggacgcccgcacctacagcgacccgctcgcgctgcgggagttcaaggagttcgccgccgggcgccggagcgtctccggcgacctgatcctcgagatcggcaagctgccccagcacctgacgctccgcgcccagaacgccctggacaacctggtgatgctccacaacagcgagcagggcgggaaggcgtaccggcacgccatggaggagctgcccgacaccatcgagaccctgatgctcctggccctgatcgccgtgctcaccgggggcgtcacgctgttcttcctgtccgggaagggcctcggcaagaccagcatcgggctgctgtgcgtgaccgcgtccagcgccctcctgtggatggcctccgtggagccccactggatcgccgccagcatcatcctggagttcttcctcatggtcctgctgatcccggagcccgaccgccagcggacgccccaggacaaccagctcgcgtacgtggtgatcggcctgctgttcatgatcctcacggtcgccgccaacgagatggggctgctggagaccaccaagaaggacctcggcatcgggcacgtggccgccgagaaccaccagcacgcgaccatgctggacgtggacctgcacccggcctccgcctggacgctctacgccgtcgccaccaccgtgatcacccccatgatgcgccacacgatcgagaacaccaccgcgaacatcagcctgaccgccatcgccaaccaggccgccatcctgatgggcctcgacaagggctggcccatctccaagatggacctgggggtgcccctgctcgcgctgggctgctacagccaggtcaacccgctgacgctcaccgccgccgtgctgatgctggtggcccactacgcgatcatcgggcccggcctccaggccaaggccacccgggaggcccagaagcgcaccgccgcggggatcatgaagaaccccacggtcgacggcatcgtggccatcgacctggaccccgtggtctacgacgccaagttcgagaagcagctgggccagatcatgctcctgatcctgtgcacctcccagatcctcctgatgcggaccacctgggccctgtgcgagagcatcacgctcgccaccgggccgctgaccaccctgtgggagggctcccccgggaagttctggaacacgaccatcgcggtgagcatggccaacatcttccgcggctcctacctcgccggcgccgggctggccttcagcctgatgaagtccctcggcgggggccgccgggggaccggcgcgcagggcgagaccctgggggagaagtggaagcgccagctgaaccagctcagcaagagcgagttcaacacgtacaagcggtccggcatcatggaggtggaccgcagcgaggccaaggaggggctgaagcggggcgagaccaccaagcacgccgtctcccgcgggaccgccaagctgcggtggttcgtggagcgcaacctggtgaagcccgagggcaaggtcatcgacctcggctgcgggcggggcgggtggagctactactgcgcgggcctgaagaaggtgaccgaggtgaaggggtacacgaagggcggccccgggcacgaggagccgatccccatggccacctacggctggaacctggtcaagctccactccgggaaggacgtgttcttcatgccgcccgagaagtgcgacaccctgctgtgcgacatcggcgagagctccccgaaccccaccatcgaggaggggcgcacgctccgggtgctgaagatggtcgagccctggctgcgcggcaaccagttctgcatcaagatcctcaacccctacatgccgagcgtggtggagaccctggagcagatgcagcggaagcacggcgggatgctggtccgcaaccccctctcccggaacagcacccacgagatgtactgggtgtcctgcggcaccgggaacatcgtgagcgccgtcaacatgacgtcccgcatgctgctgaaccggttcaccatggcccaccgcaagcccacctacgagcgggacgtggacctcggcgccggcacccgccacgtggcggtcgagcccgaggtggccaacctggacatcatcgggcagcgcatcgagaacatcaagaacgagcacaagagcacgtggcactacgacgaggacaacccgtacaagacctgggcctaccacggctcctacgaggtgaagcccagcgggtccgccagctccatggtcaacggcgtggtccggctgctcaccaagccctgggacgtgatccccatggtgacccagatcgccatgacggacaccaccccgttcgggcagcagcgcgtcttcaaggagaaggtggacacccggacgccccgcgcgaagcggggcaccgcccagatcatggaggtgaccgccaagtggctgtggggcttcctgagccgcaacaagaagccccggatctgcacccgcgaggagttcacgcggaaggtccgcagcaacgccgccatcggggcggtgttcgtggacgagaaccagtggaactccgccaaggaggccgtcgaggacgagcggttctgggacctcgtgcaccgcgagcgggagctgcacaagcagggcaagtgcgcgacctgcgtgtacaacatgatggggaagcgcgagaagaagctgggcgagttcgggaaggcgaagggcagccgggccatctggtacatgtggctcggcgcccgcttcctggagttcgaggccctggggttcatgaacgaggaccactggttctcccgggagaacagcctctccggcgtcgagggggagggcctgcacaagctggggtacatcctccgcgacatcagcaagatcccgggcggcaacatgtacgccgacgacaccgcggggtgggacacccggatcacggaggacgacctgcagaacgaggccaagatcaccgacatcatggagcccgagcacgccctgctcgccacctccatcttcaagctgacctaccagaacaaggtggtgcgcgtccagcggcccgccaagaacggcacggtgatggacgtgatcagccgccgcgaccagcgggggtccggccaggtcggcacctacgggctgaacaccttcaccaacatggaggtgcagctcatccgccagatggagagcgagggcatcttcttcccctccgagctggagagcccgaacctggcggagcgggtgctcgactggctggagaagcacggggccgagcgcctgaagcggatggccatctccggcgacgactgcgtcgtgaagcccatcgacgaccgcttcgccacggccctcatcgcgctgaacgacatggggaaggtgcggaaggacatcccccagtgggagcccagcaagggctggaacgactggcagcaggtcccgttctgctcccaccacttccaccagctgatcatgaaggacggccgcgagatcgtggtgccctgccggaaccaggacgagctcgtcgggcgcgcccgggtgagccagggcgccgggtggtccctgcgcgagaccgcctgcctgggcaagagctacgcccagatgtggcagctcatgtacttccaccggcgcgacctgcggctggcggccaacgccatctgcagcgccgtgcccgtcgactgggtgcccacctcccgcaccacctggagcatccacgcgcaccaccagtggatgacgaccgaggacatgctctccgtgtggaaccgggtctggatcgaggagaacccgtggatggaggacaagacccacgtgagctcctgggaggaggtgccctacctggggaagcgcgaggaccagtggtgcggcagcctgatcggcctcaccgcccgggccacgtgggccaccaacatccaggtcgccatcaaccaggtgcgccgcctgatcgggaacgagaactacctggactacatgacctccatgaagcggttcaagaacgagagcgaccccgagggcgcgctctggtga

SEQ ID NO: 7934 - RNA, 9879 nt, synthetic construct
  misc_feature 1..9879: note = derived and/or modified CDS sequence (opt1) from DENV-1__JX669473__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccagctccgagatccagctgacggactacggggccctcaccctggactgcagcccccggaccggcctggacttcaacgagatggtcctcctgaccatgaaggagaagtcctggctggtgcacaagcagtggttcctcgacctgccgctgccctggacgagcggggccagcacctcccaggagacctggaaccgccaggacctcctggtgaccttcaagacggcccacgcgaagaagcaggaggtcgtggtgctgggcagccaggagggcgccatgcacaccgccctcaccggggccaccgagatccagacgtccggcaccaccaccatcttcgccgggcacctgaagtgccggctgaagatggacaagctcacgctgaagggcaccagctacgtcatgtgcaccgggtccttcaagctggagaaggaggtggcggagacccagcacggcacggtgctggtccaggtgaagtacgagggcaccgacgccccctgcaagatccccttcagcacccaggacgagaagggggtgacccagaacggccgcctcatcacggccaacccgatcgtcaccgacaaggagaagcccgtgaacatcgagaccgagccgcccttcggggagtcctacatcgtggtcggcgccggcgagaaggcgctgaagctgagctggttcaagaaggggtccagcatcggcaagatgttcgaggccaccgcccgcggggcccgccggatggccatcctcggcgacacggcgtgggacttcgggtccatcggcggcgtgttcaccagcgtggggaagctggtccaccaggtgttcggcaccgcctacggggtgctgttctccggcgtcagctggaccatgaagatcgggatcggcatcctcctgacgtggctgggcctcaactcccgcagcacctccctgagcatgacctgcatcgccgtggggatggtgaccctgtacctcggcgtcatggtgcaggccgactccgggtgcgtgatcaactggaagggccgcgagctgaagtgcgggagcggcatcttcgtcacgaacgaggtgcacacctggaccgagcagtacaagttccaggccgacagcccgaagcggctgtccgcggccatcggccgcgcctgggaggagggggtgtgcggcatccggagcgccacccgcctcgagaacatcatgtggaagcagatctccaacgagctgaaccacatcctgctcgagaacgacatgaagttcaccgtcgtggtggggaacgccaacggcatcctggcgcaggggaagaagatgatcaagccccagcccatggagcacaagtacagctggaagtcctggggcaaggccaagatcatcggcgccgacatccagaacgccacgttcatcatcgacgggcccgacaccccggagtgccccgacgagcagcgggcgtggaacatctgggaggtcgaggactacggcttcgggatcttcaccaccaacatctggctgaagctccgcgacagctacacgcagatgtgcgaccaccggctgatgtccgccgccatcaaggacagcaaggccgtgcacgccgacatgggctactggatcgagtccgagaagaacgagacctggaagctggcgcgcgccagcttcatcgaggtgaagacctgcatctggcccaagtcccacaccctctggagcaacggcgtcctggagtccgagatgatcatccccaagatgtacgggggcccgatcagccagcacaactaccggcccgggtacttcacgcagaccgccggcccctggcacctggggaagctcgagctggacttcgacctgtgcgagggcaccaccgtggtggtcgacgagcactgcggctcccgcgggccgagcctccggacgaccaccgtgaccggcaagatcatccacgagtggtgctgccgctcctgcacgctgccgcccctgcggttccgcggggaggacggctgctggtacgggatggagatccggcccgtgaaggagaaggaggagaacctcgtccgcagcatggtgagcgccggctccggcgaggtggacagcttctccctggggatcctgtgcgtcagcatcatgatcgaggaggtgatgcggtcccgctggagccggaagatgctcatgaccggcaccctggccgtgttcctgctcctgatcatggggcagctgacctggaacgacctcatccgcctgtgcatcatggtcggcgcgaacgcctccgacaagatggggatgggcacgacctacctggccctcatggccaccttcaagatgcgcccgatgttcgccgtggggctgctgttccggcgcctcaccagccgggaggtgctgctgctcacgatcgggctgtccctggtcgcgagcgtggagctccccaactccctggaggagctgggcgacgggctcgccatgggcatcatgatgctgaagctgctcaccgagttccagccccaccagctgtggaccaccctgctcagcctgacgttcatcaagaccaccctgtccctcgactacgcctggaagaccacggccaccgtcctgagcatcgtgtccctgttccccctctgcctgagcaccacctcccagaagacgacctggctgccggtgctcctgggcagcttcgggtgcaagcccctgaccatgttcctcatcaccgagaacaagatctggggccgcaagtcctggcccctgaacgaggggatcatggcgatcggcatcgtcagcatcctgctcagctccctgctgaagaacgacgtgcccctcgccgggccgctgatcgccggcggcatgctgatcgcctgctacgtgatcagcgggtccagcgccgacctctccctggagaaggcggccgaggtcagctgggaggaggaggccgagcactccggcaccagccacaacatcctggtggaggtgcaggacgacgggacgatgaagatcaaggacgaggagcgggacgacaccctcaccatcctgctgaaggccaccctcctggccgtctccggcgtgtaccccatgagcatccccgcgacgctgttcgtgtggtacttctggcagaagaagaagcagcgctccggggtcctctgggacacccccagcccgcccgaggtggagcgggccgtgctggacgacggcatctaccgcatcctgcagcggggcctgctcgggcgctcccaggtcggcgtgggggtgttccaggacggcgtcttccacaccatgtggcacgtgacccgcggggccgtgctgatgtaccagggcaagcgcctggagcccagctgggcctccgtcaagaaggacctcatcagctacggcgggggctggcggttccaggggtcctggaacacgggcgaggaggtccaggtgatcgccgtcgagcccgggaagaacccgaagaacgtgcagaccacccccggcaccttcaagacgcccgagggcgaggtgggggcgatcgccctggacttcaagcccggcaccagcgggtccccgatcgtcaaccgcgagggcaagatcgtgggcctgtacgggaacggcgtggtcaccaccagcgggacgtacgtgagcgccatcgcccaggccaaggcgtcccaggagggccccctccccgagatcgaggacgaggtgttcaagaagcggaacctgaccatcatggacctgcacccggggagcggcaagacccgccggtacctccccgccatcgtccgcgaggccatcaagcggaagctgcgcaccctgatcctcgcccccacgcgggtggtggcgtccgagatggccgaggccctgaagggcatgcccatccgctaccagaccaccgccgtcaagagcgagcacaccgggcgcgagatcgtggacctgatgtgccacgccacgttcaccatgcggctcctgtccccggtgcgcgtccccaactacaacatgatcatcatggacgaggcgcacttcaccgaccccgccagcatcgccgcccggggctacatctccacccgcgtggggatgggcgaggccgcggccatcttcatgacggccacgccgcccgggagcgtggaggccttcccccagtccaacgccgtcatccaggacgaggagcgggacatccccgagcgcagctggaactccggctacgactggatcaccgacttccccggcaagaccgtgtggttcgtgcccagcatcaagtccgggaacgacatcgcgaactgcctgcggaagaacggcaagcgcgtcatccagctcagccggaagacgttcgacaccgagtaccagaagaccaagaacaacgactgggactacgtggtgaccacggacatctccgagatgggggccaacttccgcgccgaccgggtcatcgacccccgccggtgcctgaagcccgtgatcctgaaggacggccccgagcgcgtgatcctcgccgggccgatgcccgtcaccgtggcgagcgccgcccagcggcgcggccggatcggccgcaaccagaacaaggagggggaccagtacgtctacatgggccagcccctgaacaacgacgaggaccacgcccactggaccgaggccaagatgctgctcgacaacatcaacacccccgaggggatcatcccggcgctgttcgagcccgagcgggagaagtccgccgccatcgacggcgagtaccgcctgcgcggggaggcccggaagacgttcgtggagctcatgcgccggggcgacctgcccgtgtggctgagctacaaggtcgcctccgagggcttccagtacagcgaccgccggtggtgcttcgacggggagcgcaacaaccaggtgctcgaggagaacatggacgtggagatctggaccaaggagggcgagcggaagaagctgcgcccccggtggctggacgcgcgcacctacagcgacccgctcgccctgcgggagttcaaggagttcgccgccgggcgccggtccgtcagcggcgacctgatcctcgagatcggcaagctgccccagcacctgaccctccgcgcccagaacgcgctggacaacctggtgatgctccacaactccgagcagggcgggaaggcctaccggcacgccatggaggagctgcccgacaccatcgagacgctgatgctcctggccctgatcgcggtgctcaccgggggcgtcaccctgttcttcctgagcgggaagggcctcggcaagacctccatcgggctgctgtgcgtgacggccagctccgccctcctgtggatggccagcgtggagccccactggatcgccgcgtccatcatcctggagttcttcctcatggtcctgctgatcccggagcccgaccgccagcggacgccccaggacaaccagctcgcctacgtggtgatcggcctgctgttcatgatcctcaccgtcgccgccaacgagatggggctgctggagaccacgaagaaggacctcggcatcgggcacgtggccgcggagaaccaccagcacgccaccatgctggacgtggacctgcacccggccagcgcctggaccctctacgccgtcgcgaccacggtgatcacccccatgatgcgccacaccatcgagaacaccacggccaacatctccctgaccgccatcgccaaccaggccgcgatcctgatgggcctcgacaagggctggcccatcagcaagatggacctgggggtgcccctgctcgccctgggctgctactcccaggtcaacccgctgaccctcaccgccgccgtgctgatgctggtggcgcactacgccatcatcgggcccggcctccaggccaaggccacgcgggaggcccagaagcgcaccgcggccgggatcatgaagaaccccaccgtcgacggcatcgtggccatcgacctggaccccgtggtctacgacgccaagttcgagaagcagctgggccagatcatgctcctgatcctgtgcaccagccagatcctcctgatgcggacgacctgggccctgtgcgagtccatcaccctcgcgaccgggccgctgacgaccctgtgggagggcagccccgggaagttctggaacaccaccatcgccgtgtccatggccaacatcttccgcggcagctacctcgccggcgccgggctggcgttctccctgatgaagtccctcggcgggggccgccgggggacgggcgcccagggcgagaccctgggggagaagtggaagcgccagctgaaccagctcagcaagtccgagttcaacacctacaagcggagcggcatcatggaggtggaccgctccgaggccaaggaggggctgaagcggggcgagaccacgaagcacgccgtcagccgcgggaccgcgaagctgcggtggttcgtggagcgcaacctggtgaagcccgagggcaaggtcatcgacctcggctgcgggcggggcgggtggtcctactactgcgccggcctgaagaaggtgaccgaggtgaaggggtacaccaagggcggccccgggcacgaggagccgatccccatggccacctacggctggaacctggtcaagctccacagcgggaaggacgtgttcttcatgccgcccgagaagtgcgacacgctgctgtgcgacatcggcgagtccagcccgaaccccaccatcgaggaggggcgcaccctccgggtgctgaagatggtcgagccctggctgcgcggcaaccagttctgcatcaagatcctcaacccctacatgccgtccgtggtggagaccctggagcagatgcagcggaagcacggcgggatgctggtccgcaaccccctcagccggaactccacgcacgagatgtactgggtgagctgcggcaccgggaacatcgtgtccgccgtcaacatgaccagccgcatgctgctgaaccggttcaccatggcccaccgcaagcccacgtacgagcgggacgtggacctcggcgcgggcacccgccacgtggccgtcgagcccgaggtggccaacctggacatcatcgggcagcgcatcgagaacatcaagaacgagcacaagtccacctggcactacgacgaggacaacccgtacaagacctgggcctaccacggcagctacgaggtgaagccctccgggagcgcctccagcatggtcaacggcgtggtccggctgctcacgaagccctgggacgtgatccccatggtgacccagatcgcgatgaccgacaccacgccgttcgggcagcagcgcgtcttcaaggagaaggtggacacccggacgccccgggccaagcggggcaccgcccagatcatggaggtgacggccaagtggctgtggggcttcctgagccgcaacaagaagccccggatctgcacccgcgaggagttcacccggaaggtccgctccaacgccgcgatcggggccgtgttcgtggacgagaaccagtggaacagcgccaaggaggccgtcgaggacgagcggttctgggacctcgtgcaccgcgagcgggagctgcacaagcagggcaagtgcgcgacctgcgtgtacaacatgatggggaagcgcgagaagaagctgggcgagttcgggaaggccaagggctcccgggccatctggtacatgtggctcggcgcccgcttcctggagttcgaggccctggggttcatgaacgaggaccactggttcagccgggagaactccctcagcggcgtcgagggggagggcctgcacaagctggggtacatcctccgcgacatctccaagatcccgggcggcaacatgtacgcggacgacacggccgggtgggacacccggatcaccgaggacgacctgcagaacgaggccaagatcaccgacatcatggagcccgagcacgccctgctcgccacgagcatcttcaagctgacctaccagaacaaggtggtgcgcgtccagcggcccgcgaagaacggcaccgtgatggacgtgatctcccgccgcgaccagcgggggagcggccaggtcggcacctacgggctgaacacgttcaccaacatggaggtgcagctcatccgccagatggagtccgagggcatcttcttccccagcgagctggagtccccgaacctggccgagcgggtgctcgactggctggagaagcacggggccgagcgcctgaagcggatggccatcagcggcgacgactgcgtcgtgaagcccatcgacgaccgcttcgccaccgcgctcatcgccctgaacgacatggggaaggtgcggaaggacatcccccagtgggagccctccaagggctggaacgactggcagcaggtcccgttctgcagccaccacttccaccagctgatcatgaaggacggccgcgagatcgtggtgccctgccggaaccaggacgagctcgtcgggcgcgcccgggtgtcccagggcgccgggtggagcctgcgcgagaccgcctgcctgggcaagagctacgcgcagatgtggcagctcatgtacttccaccggcgcgacctgcggctggccgccaacgccatctgctccgcggtgcccgtcgactgggtgcccacgagccgcaccacctggtccatccacgcccaccaccagtggatgaccaccgaggacatgctcagcgtgtggaaccgggtctggatcgaggagaacccgtggatggaggacaagacgcacgtgtccagctgggaggaggtgccctacctggggaagcgcgaggaccagtggtgcggctccctgatcggcctcaccgcccgggccacctgggccaccaacatccaggtcgcgatcaaccaggtgcgccgcctgatcgggaacgagaactacctggactacatgacgagcatgaagcggttcaagaacgagtccgaccccgagggcgccctctggtga

SEQ ID NO: 7935 - RNA, 9879 nt, synthetic construct
  misc_feature 1..9879: note = derived and/or modified CDS sequence (opt1) from DENV-1__JX669474__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccgcctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccgccggatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgcgagctgaagtgcgggtccggcatcttcgtcacgaacgaggtgcacacctggaccgagcagtacaagttccaggccgacagcccgaagcggctgagcgcggccatcggccgcgcctgggaggagggggtgtgcggcatccggtccgccacccgcctcgagaacatcatgtggaagcagatcagcaacgagctgaaccacatcctgctcgagaacgacatgaagttcaccgtcgtggtggggaacgccaacggcatcctggcgcaggggaagaagatgatcaagccccagcccatggagcacaagtactcctggaagtcctggggcaaggccaagatcatcggcgccgacatccagaacgccacgttcatcatcgacgggcccgacaccccggagtgccccgacgagcagcgggcgtggaacatctgggaggtcgaggactacggcttcgggatcttcaccaccaacatctggctgaagctccgcgactcctacacgcagatgtgcgaccaccggctgatgagcgccgccatcaaggactccaaggccgtgcacgccgacatgggctactggatcgagagcgagaagaacgagacctggaagctggcgcgcgcctccttcatcgaggtgaagacctgcatctggcccaagagccacaccctctggtccaacggcgtcctggagagcgagatgatcatccccaagatgtacgggggcccgacgtcccagcacaactaccggcccgggtacttcacccagaccgccggcccctggcacctggggaagctcgagctggacttcgacctgtgcgagggcaccacggtggtggtcgacgagcactgcggcagccgcgggccgtccctccggaccaccaccgtgacgggcaagatcatccacgagtggtgctgccgcagctgcaccctgccgcccctgcggttccgcggggaggacggctgctggtacgggatggagatccggcccgtgaaggagaaggaggagaacctcgtccgctccatggtgagcgccggcagcggcgaggtggactccttcagcctggggatcctgtgcgtctccatcatgatcgaggaggtgatgcggagccgctggtcccggaagatgctcatgaccggcaccctggccgtgttcctgctcctgatcatggggcagctgacgtggaacgacctcatccgcctgtgcatcatggtcggcgcgaacgccagcgacaagatggggatgggcaccacctacctggccctcatggccaccttcaagatgcgcccgatgttcgccgtggggctgctgttccggcgcctcacgtcccgggaggtgctgctgctcaccatcgggctgagcctggtcgcgtccgtggagctccccaacagcctggaggagctgggcgacgggctcgccatgggcatcatgatgctgaagctgctcaccgagttccagccccaccagctgtggaccacgctgctctccctgaccttcatcaagaccaccctgagcctcgactacgcctggaagacgaccgccaccgtcctgtccatcgtgagcctgttccccctctgcctgtccaccacgagccagaagaccacctggctgccggtgctcctgggctccttcgggtgcaagcccctgaccatgttcctcatcaccgagaacgagatctggggccgcaagagctggcccctgaacgaggggatcatggcgatcggcatcgtctccatcctgctcagcagcctgctgaagaacgacgtgcccctcgccgggccgctgatcgccggcggcatgctgatcgcctgctacgtgatctccgggagctccgccgacctcagcctggagaaggcggccgaggtctcctgggaggaggaggccgagcacagcggcacgtcccacaacatcctggtggaggtgcaggacgacgggaccatgaagatcaaggacgaggagcgggacgacaccctcaccatcctgctgaaggccacgctcctggccatcagcggcgtctaccccatgtccatccccgcgaccctgttcgtgtggtacttctggcagaagaagaagcagcgcagcggggtgctctgggacaccccctccccgcccgaggtcgagcgggccgtgctggacgacggcatctaccgcatcctgcagcggggcctgctcgggcgcagccaggtgggcgtcggggtgttccaggacggcgtgttccacaccatgtggcacgtcacgcgcggggccgtgctgatgtaccagggcaagcgcctggagccctcctgggccagcgtgaagaaggacctcatctcctacggcgggggctggcggttccaggggagctggaacaccggcgaggaggtccaggtgatcgccgtggagcccgggaagaacccgaagaacgtccagaccacccccggcacgttcaagacccccgagggcgaggtgggggcgatcgccctggacttcaagcccggcacctccgggagcccgatcgtgaaccgcgagggcaagatcgtcggcctgtacgggaacggcgtggtgaccacgtccgggacctacgtcagcgccatcgcccaggccaaggcgagccaggagggccccctccccgagatcgaggacgaggtgttcaagaagcggaacctgaccatcatggacctgcacccggggtccggcaagacccgccggtacctccccgccatcgtgcgcgaggccatcaagcggaagctgcgcacgctgatcctcgcccccacccgggtcgtggcgagcgagatggccgaggccctgaagggcatgcccatccgctaccagaccaccgccgtgaagtccgagcacacggggcgcgagatcgtcgacctgatgtgccacgccaccttcaccatgcggctcctgagcccggtgcgcgtgcccaactacaacatgatcatcatggacgaggcgcacttcaccgaccccgcctccatcgccgcccggggctacatcagcacgcgcgtcgggatgggcgaggccgcggccatcttcatgaccgccacgccgcccgggtccgtggaggccttcccccagagcaacgccgtgatccaggacgaggagcgggacatccccgagcgctcctggaacagcggctacgactggatcaccgacttccccggcaagacggtctggttcgtgccctccatcaagagcgggaacgacatcgcgaactgcctgcggaagaacggcaagcgcgtgatccagctctcccggaagaccttcgacaccgagtaccagaagaccaagaacaacgactgggactacgtcgtgacgaccgacatcagcgagatgggggccaacttccgcgccgaccgggtgatcgacccccgccggtgcctgaagcccgtcatcctgaaggacggccccgagcgcgtgatcctcgccgggccgatgcccgtgaccgtcgcgtccgccgcccagcggcgcggccggatcggccgcaaccagaacaaggagggggaccagtacgtgtacatgggccagcccctgaacaacgacgaggaccacgcccactggaccgaggccaagatgctgctcgacaacatcaacacgcccgaggggatcatcccggcgctgttcgagcccgagcgggagaagtccgccgccatcgacggcgagtaccgcctgcgcggggaggcccggaagaccttcgtcgagctcatgcgccggggcgacctgcccgtgtggctgtcctacaaggtggccagcgagggcttccagtactccgaccgccggtggtgcttcgacggggagcgcaacaaccaggtcctcgaggagaacatggacgtggagatctggaccaaggagggcgagcggaagaagctgcgcccccggtggctggacgcgcgcacctacagcgacccgctcgccctgcgggagttcaaggagttcgccgccgggcgccggagcgtgtccggcgacctgatcctcgagatcggcaagctgccccagcacctgaccctccgcgcccagaacgcgctggacaacctggtcatgctccacaacagcgagcagggcgggaaggcctaccggcacgccatggaggagctgcccgacacgatcgagaccctgatgctcctggccctgatcgcggtgctcaccgggggcgtgaccctgttcttcctgtccgggaagggcctcggcaagacgagcatcgggctgctgtgcgtcaccgcctccagcgccctcctgtggatggcctccgtggagccccactggatcgccgcgagcatcatcctggagttcttcctcatggtgctgctgatcccggagcccgaccgccagcggacgccccaggacaaccagctcgcctacgtcgtgatcggcctgctgttcatgatcctcaccgtggccgccaacgagatggggctgctggagacgaccaagaaggacctcggcatcgggcacgtcgccgcggagaaccaccagcacgccaccatgctggacgtggacctgcacccggcctccgcctggaccctctacgccgtggcgacgaccgtcatcacccccatgatgcgccacaccatcgagaacacgaccgccaacatcagcctgaccgccatcgccaaccaggccgcgatcctgatgggcctcgacaagggctggcccatctccaagatggacctgggggtgcccctgctcgccctgggctgctacagccaggtgaacccgctgaccctcacggccgccgtcctgatgctggtggcgcactacgccatcatcgggcccggcctccaggccaaggccacccgggaggcccagaagcgcaccgcggccgggatcatgaagaaccccaccgtggacggcatcgtcgccatcgacctggaccccgtggtgtacgacgccaagttcgagaagcagctgggccagatcatgctcctgatcctgtgcacgtcccagatcctcctgatgcggaccacctgggccctgtgcgagagcatcaccctcgcgacggggccgctgaccaccctgtgggagggctcccccgggaagttctggaacaccacgatcgccgtcagcatggccaacatcttccgcggctcctacctcgccggcgccgggctggcgttcagcctgatgaagtccctcggcgggggccgccgggggaccggcgcccagggcgagaccctgggggagaagtggaagcgccagctgaaccagctcagcaagagcgagttcaacacctacaagcggtccggcatcatggaggtggaccgcagcgaggccaaggaggggctgaagcggggcgagacgaccaagcacgccgtgtcccgcgggaccgcgaagctgcggtggttcgtcgagcgcaacctggtgaagcccgagggcaaggtgatcgacctcggctgcgggcggggcgggtggagctactactgcgccggcctgaagaaggtcaccgaggtgaaggggtacaccaagggcggccccgggcacgaggagccgatccccatggccacgtacggctggaacctggtgaagctccactccgggaaggacgtcttcttcatgccgcccgagaagtgcgacaccctgctgtgcgacatcggcgagagctccccgaaccccaccatcgaggaggggcgcaccctccgggtgctgaagatggtggagccctggctgcgcggcaaccagttctgcatcaagatcctcaacccctacatgccgagcgtcgtggagacgctggagcagatgcagcggaagcacggcgggatgctggtgcgcaaccccctctcccggaacagcacccacgagatgtactgggtctcctgcggcaccgggaacatcgtgagcgccgtgaacatgacctcccgcatgctgctgaaccggttcacgatggcccaccgcaagcccacctacgagcgggacgtcgacctcggcgcgggcacccgccacgtggccgtggagcccgaggtcgccaacctggacatcatcgggcagcgcatcgagaacatcaagaacgagcacaagagcacctggcactacgacgaggacaacccgtacaagacgtgggcctaccacggctcctacgaggtgaagcccagcgggtccgccagctccatggtgaacggcgtcgtgcggctgctcaccaagccctgggacgtcatccccatggtgacccagatcgcgatgaccgacacgaccccgttcgggcagcagcgcgtgttcaaggagaaggtcgacacccggacgccccgggccaagcggggcacggcccagatcatggaggtgaccgccaagtggctgtggggcttcctgagccgcaacaagaagccccggatctgcacccgcgaggagttcacccggaaggtgcgcagcaacgccgcgatcggggccgtcttcgtggacgagaaccagtggaactccgccaaggaggccgtggaggacgagcggttctgggacctcgtccaccgcgagcgggagctgcacaagcagggcaagtgcgcgacgtgcgtgtacaacatgatggggaagcgcgagaagaagctgggcgagttcgggaaggccaagggcagccgggccatctggtacatgtggctcggcgcccgcttcctggagttcgaggccctggggttcatgaacgaggaccactggttctcccgggagaacagcctctccggcgtggagggggagggcctgcacaagctggggtacatcctccgcgacatcagcaagatcccgggcggcaacatgtacgcggacgacaccgccgggtgggacacccggatcaccgaggacgacctgcagaacgaggccaagatcacggacatcatggagcccgagcacgccctgctcgccacctccatcttcaagctgacctaccagaacaaggtcgtgcgcgtgcagcggcccgcgaagaacggcaccgtcatggacgtgatcagccgccgcgaccagcgggggtccggccaggtgggcacgtacgggctgaacaccttcaccaacatggaggtccagctcatccgccagatggagagcgagggcatcttcttcccctccgagctggagagcccgaacctggccgagcgggtgctcgactggctggagaagcacggggccgagcgcctgaagcggatggccatctccggcgacgactgcgtggtcaagcccatcgacgaccgcttcgccaccgcgctcatcgccctgaacgacatggggaaggtgcggaaggacatcccccagtgggagcccagcaagggctggaacgactggcagcaggtcccgttctgctcccaccacttccaccagctgatcatgaaggacggccgcgagatcgtcgtgccctgccggaaccaggacgagctcgtggggcgcgcccgggtcagccagggcgccgggtggtccctgcgcgagacggcctgcctgggcaagagctacgcgcagatgtggcagctcatgtacttccaccggcgcgacctgcggctggccgccaacgccatctgcagcgcggtgcccgtggactgggtccccacctcccgcaccacctggagcatccacgcccaccaccagtggatgaccacggaggacatgctctccgtgtggaaccgggtgtggatcgaggagaacccgtggatggaggacaagacccacgtcagctcctgggaggaggtgccctacctggggaagcgcgaggaccagtggtgcggcagcctgatcggcctcaccgcccgggccacctgggccacgaacatccaggtggcgatcaaccaggtccgccgcctgatcgggaacgagaactacctggactacatgacctccatgaagcggttcaagaacgagagcgaccccgagggcgccctctggtga

SEQ ID NO: 7936 - RNA, 9879 nt, synthetic construct
  misc_feature 1..9879: note = derived and/or modified CDS sequence (opt1) from DENV-1__JX669475__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgggacaagcggtccgtggccctggcgccccacgtgggcctggggctcgagacccgcaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccgcctcatcaccgccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgcgagctgaagtgcgggtccggcatcttcgtcaccaacgaggtgcacacctggaccgagcagtacaagttccaggccgacagcccgaagcggctgagcgcggccatcggcaaggcctgggaggagggggtgtgcggcatccgctccgccacccggctcgagaacatcatgtggaagcagatcagcaacgagctgaaccacatcctgctcgagaacgacatcaagttcacggtcgtggtggggaacgccaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacgagcagcgggcctggaacatctgggaggtcgaggactacggcttcgggatcttcacgaccaacatctggctgaagctccgcgactcctacacccagatgtgcgaccaccggctgatgagcgcggccatcaaggactccaaggccgtgcacgccgacatgggctactggatcgagagcgagaagaacgagacctggaagctggcccgcgcgtccttcatcgaggtgaagacgtgcatctggcccaagagccacaccctctggtccaacggcgtcctggagagcgagatgatcatccccaagatgtacgggggcccgatctcccagcacaactaccggcccgggtacttcacccagaccgccggcccctggcacctggggaagctcgagctggacttcgacctgtgcgagggcacgaccgtggtggtcgacgagcactgcggcagccgcgggccgtccctccggaccaccacggtgaccggcaagatcatccacgagtggtgctgccgcagctgcaccctgccgcccctgcggttccgcggggaggacggctgctggtacgggatggagatccggcccgtgaaggagaaggaggagaacctcgtccgctccatggtgagcgccggcagcggcgaggtggactccttcagcctggggatcctgtgcgtctccatcatgatcgaggaggtgatgcggagccgctggtcccggaagatgctcatgaccggcacgctggccgtgttcctgctcctgatcatggggcagctgacctggaacgacctcatccgcctgtgcatcatggtcggcgccaacgcgagcgacaagatggggatgggcaccacctacctggccctcatggccacgttcaagatgcgcccgatgttcgccgtggggctgtccttccggcgcctgaccagccgggaggtgctcctgctgaccatcgggctctccctggtcgccagcgtggagctgcccaactccctcgaggagctgggcgacgggctggcgatgggcatcatgatgctcaagctgctgaccgagttccagccccaccagctctggacgaccctgctgagcctcaccttcatcaagaccacgctgtccctggactacgcctggaagaccaccgccatggtcctcagcatcgtgtccctgttccccctgtgcctcagcaccacgtcccagaagaccacctggctgccggtgctgctcggcagcttcgggtgcaagcccctgaccatgttcctgatcaccgagaacgagatctggggccgcaagtcctggcccctcaacgaggggatcatggccatcggcatcgtcagcatcctgctgagctccctcctgaagaacgacgtgcccctggcggggccgctcatcgccggcggcatgctgatcgcctgctacgtgatcagcgggtccagcgccgacctgtccctcgagaaggccgcggaggtcagctgggaggaggaggccgagcactccggcacgagccacaacatcctggtggaggtgcaggacgacgggaccatgaagatcaaggacgaggagcgggacgacaccctgaccatcctcctgaaggccacgctgctcgccgtctccggcgtgtaccccatgagcatccccgccaccctgttcgtgtggtacttctggcagaagaagaagcagcgctccggggtcctgtgggacacccccagcccgcccgaggtggagcgggcggtgctcgacgacggcatctaccgcatcctgcagcggggcctgctggggcgctcccaggtcggcgtgggggtgttccaggacggcgtcttccacaccatgtggcacgtgacgcgcggggccgtgctcatgtaccagggcaagcgcctggagcccagctgggcctccgtcaagaaggacctgatcagctacggcgggggctggcggttccaggggtcctggaacaccggcgaggaggtccaggtgatcgccgtcgagcccgggaagaacccgaagaacgtgcagaccacccccggcacgttcaagacccccgagggcgaggtgggggccatcgcgctcgacttcaagcccggcaccagcgggtccccgatcgtcaaccgcgagggcaagatcgtgggcctgtacgggaacggcgtggtcaccacgagcgggacctacgtgagcgccatcgcccaggccaaggcctcccaggagggccccctgcccgagatcgaggacgaggtgttccggaagcgcaacctcaccatcatggacctgcacccggggagcggcaagacccggcgctacctgcccgcgatcgtccgggaggccatcaagcgcaagctccggacgctgatcctggcccccacccgcgtggtggcctccgagatggcggaggccctcaagggcatgcccatccgctaccagaccaccgccgtcaagagcgagcacacggggcgggagatcgtggacctgatgtgccacgccaccttcaccatgcgcctgctctccccggtgcgggtccccaactacaacatgatcatcatggacgaggcccacttcaccgaccccgcgagcatcgccgcccgcggctacatctccacgcgggtggggatgggcgaggccgccgcgatcttcatgaccgccacgccgcccgggagcgtggaggccttcccccagtccaacgccgtcatccaggacgaggagcgcgacatccccgagcggagctggaactccggctacgactggatcaccgacttccccggcaagacggtgtggttcgtgcccagcatcaagtccgggaacgacatcgccaactgcctgcgcaagaacggcaagcgggtcatccagctgagccgcaagaccttcgacaccgagtaccagaagaccaagaacaacgactgggactacgtggtgacgaccgacatctccgagatgggggcgaacttccgggccgaccgcgtcatcgacccccggcgctgcctcaagcccgtgatcctgaaggacggccccgagcgggtgatcctggccgggccgatgcccgtcaccgtggccagcgcggcccagcgccggggccgcatcggccggaaccagaacaaggagggggaccagtacgtctacatgggccagcccctcaacaacgacgaggaccacgcccactggaccgaggccaagatgctgctggacaacatcaacacgcccgaggggatcatcccggccctcttcgagcccgagcgcgagaagtccgcggccatcgacggcgagtaccgcctgcgcggggaggcccgcaagaccttcgtggagctgatgcggcgcggcgacctccccgtgtggctgagctacaaggtcgcctccgagggcttccagtacagcgaccggcgctggtgcttcgacggggagcggaacaaccaggtgctggaggagaacatggacgtggagatctggaccaaggagggcgagcgcaagaagctccggccccgctggctggacgcccggacctacagcgacccgctggcgctccgcgagttcaaggagttcgccgccgggcggcgctccgtcagcggcgacctgatcctggagatcggcaagctcccccagcacctgaccctgcgggcccagaacgccctcgacaacctggtgatgctgcacaactccgagcagggcgggaaggcgtaccgccacgccatggaggagctccccgacacgatcgagaccctgatgctgctcgccctgatcgccgtgctgaccgggggcgtcaccctcttcttcctgagcgggaagggcctgggcaagacgtccatcgggctcctgtgcgtgaccgcgagctccgccctgctctggatggccagcgtggagccccactggatcgccgcctccatcatcctggagttcttcctgatggtcctcctgatcccggagcccgaccggcagcgcacgccccaggacaaccagctggcgtacgtggtgatcggcctcctgttcatgatcctgaccgtcgccgccaacgagatggggctcctggagacgaccaagaaggacctgggcatcgggcacgtggccgccgagaaccaccagcacgcgaccatgctcgacgtggacctgcacccggccagcgcctggaccctgtacgccgtcgccacgaccgtgatcacccccatgatgcggcacaccatcgagaacacgaccgcgaacatctccctcaccgccatcgccaaccaggccgccatcctgatgggcctggacaagggctggcccatcagcaagatggacctcggggtgcccctgctggcgctcggctgctactcccaggtcaacccgctgaccctgacggccgccgtgctcatgctggtggcccactacgcgatcatcgggcccggcctgcaggccaaggccacccgcgaggcccagaagcggaccgccgcggggatcatgaagaaccccaccgtcgacggcatcgtggccatcgacctcgaccccgtggtctacgacgccaagttcgagaagcagctgggccagatcatgctgctcatcctgtgcacgagccagatcctgctcatgcgcaccacctgggccctgtgcgagtccatcaccctggccacggggccgctcaccaccctgtgggagggcagccccgggaagttctggaacaccacgatcgcggtgtccatggccaacatcttccgcggcagctacctggccggcgccgggctcgccttctccctgatgaagtccctgggcgggggccggcgcgggaccggcgcgcagggcgagaccctcggggagaagtggaagcggcagctgaaccagctgagcaagtccgagttcaacacctacaagcgcagcggcatcatggaggtggaccggtccgaggccaaggaggggctcaagcgcggcgagacgaccaagcacgccgtcagccgggggaccgccaagctgcgctggttcgtggagcggaacctggtgaagcccgagggcaaggtcatcgacctgggctgcgggcgcggcgggtggtcctactactgcgcgggcctcaagaaggtgaccgaggtgaaggggtacaccaagggcggccccgggcacgaggagccgatccccatggccacgtacggctggaacctggtcaagctgcacagcgggaaggacgtgttcttcatgccgcccgagaagtgcgacaccctcctgtgcgacatcggcgagtccagcccgaaccccaccatcgaggaggggcggaccctgcgcgtgctcaagatggtcgagccctggctgcggggcaaccagttctgcatcaagatcctgaacccctacatgccgtccgtggtggagacgctcgagcagatgcagcgcaagcacggcgggatgctggtccggaaccccctgagccgcaactccacccacgagatgtactgggtgagctgcggcaccgggaacatcgtgtccgccgtcaacatgaccagccggatgctcctgaaccgcttcacgatggcccaccggaagcccacctacgagcgcgacgtggacctgggcgccggcacccgccacgtggcggtcgagcccgaggtggccaacctcgacatcatcgggcagcggatcgagaacatcaagaacgagcacaagtccacctggcactacgacgaggacaacccgtacaagacgtgggcctaccacggcagctacgaggtgaagccctccgggagcgcctccagcatggtcaacggcgtggtccgcctgctgaccaagccctgggacgtgatccccatggtgacccagatcgccatgaccgacacgaccccgttcgggcagcagcgggtcttcaaggagaaggtggacacccgcacgccccgggcgaagcgcggcacggcccagatcatggaggtgaccgccaagtggctctggggcttcctgagccggaacaagaagccccgcatctgcacccgggaggagttcacccgcaaggtccggtccaacgccgccatcggggcggtgttcgtggacgagaaccagtggaacagcgccaaggaggccgtcgaggacgagcgcttctgggacctggtgcaccgggagcgcgagctccacaagcagggcaagtgcgccacgtgcgtgtacaacatgatggggaagcgggagaagaagctgggcgagttcgggaaggcgaagggctcccgcgccatctggtacatgtggctgggcgcccggttcctcgagttcgaggccctggggttcatgaacgaggaccactggttcagccgcgagaactccctgagcggcgtcgagggggagggcctccacaagctggggtacatcctgcgggacatctccaagatcccgggcggcaacatgtacgccgacgacaccgcggggtgggacacccgcatcaccgaggacgacctccagaacgaggccaagatcacggacatcatggagcccgagcacgccctgctggccaccagcatcttcaagctcacctaccagaacaaggtggtgcgggtccagcgccccgccaagaacggcaccgtgatggacgtgatctcccgccgggaccagcgcgggagcggccaggtcggcacgtacgggctgaacaccttcaccaacatggaggtgcagctgatccggcagatggagtccgagggcatcttcttccccagcgagctcgagtccccgaacctggcggagcgcgtgctggactggctcgagaagcacggggccgagcggctgaagcgcatggccatcagcggcgacgactgcgtcgtgaagcccatcgacgaccggttcgccaccgccctgatcgcgctcaacgacatggggaaggtgcgcaaggacatcccccagtgggagccctccaagggctggaacgactggcagcaggtcccgttctgcagccaccacttccaccagctgatcatgaaggacggccgggagatcgtggtgccctgccgcaaccaggacgagctggtcgggcgggcccgcgtgtcccagggcgccgggtggagcctccgggagacggcctgcctgggcaagagctacgcccagatgtggcagctgatgtacttccaccgccgggacctccgcctggcggccaacgccatctgctccgccgtgcccgtcgactgggtgcccaccagccggaccacctggtccatccacgcgcaccaccagtggatgaccacggaggacatgctgagcgtgtggaaccgcgtctggatcgaggagaacccgtggatggaggacaagacccacgtgtccagctgggaggaggtgccctacctcgggaagcgggaggaccagtggtgcggctccctgatcggcctgaccgcccgcgccacctgggccacgaacatccaggtcgccatcaaccaggtgcgccggctcatcgggaacgagaactacctggactacatgaccagcatgaagcgcttcaagaacgagtccgaccccgagggcgcgctgtggtga

SEQ ID NO: 7937 - RNA, 9879 nt, synthetic construct
  misc_feature 1..9879: note = derived and/or modified CDS sequence (opt1) from DENV-1__JX669461__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgtgggggtgaacatgtgcaccctgatcgcgatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacgcgcaccgagacctggatgagctccgagggcgcctggaagcagatccagaaggtggagacctgggccctgcggcaccccgggttcacggtgatcgccctgttcctcgcccacgcgatcggcaccagcatcacccagaaggggatcatcttcatcctgctgatgctcgtcaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgccccacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttcctcacccaggacgagaagggggtcacccagaacggccgcctgatcacggccaacccgatcgtgaccgacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcccgccggatggccatcctgggcgacacggcctgggacttcgggtccatcggcggcctgttcaccagcgtggggaagctcatccaccaggtcttcggcaccgcgtacggggtgctgttctccggcgtgagctggaccatgaagatcgggatcggcatcctgctcacgtggctgggcctgaactcccgcagcacctccctcagcatgacctgcatcgccgtcgggatggtgaccctgtacctgggcgtgatggtccaggccgactccgggtgcgtgatcaactggaagggccgcgagctcaagtgcgggagcggcatcttcgtgacgaacgaggtccacacctggaccgagcagtacaagttccaggccgactccccgaagcggctgagcgccgcgatcggcaaggcctgggaggagggggtgtgcggcatccgcagcgccacccggctggagaacatcatgtggaagcagatctccaacgagctcaactacatcctgctggagaacgacatgaagttcaccgtggtcgtgggggacgtgaacggcatcctcgcccaggggaagaagatgatccgcccccagcccatggagcacaagtacagctggaagtcctggggcaaggccaagatcatcggcgcggacatccagaacacgaccttcatcatcgacgggcccgacaccccggagtgccccgacgaccagcgggcctggaacatctgggaggtcgaggactacggcttcgggatcttcaccacgaacatctggctgaagctgcgcgacagccacacccagatgtgcgaccaccggctcatgtccgccgccatcaaggacagcaaggcggtgcacgccgacatgggctactggatcgagtccgagaagaacgagacctggaagctggcccgcgccagcttcatcgaggtgaagacctgcatctggcccaagtcccacacgctgtggagcaacggcgtcctcgagtccgagatggtgatccccaagatctacgggggcccgatcagccagcacaactaccggcccgggtacttcacccagaccgccggcccctggcacctggggaagctggagctcgacttcgacctgtgcgagggcaccacggtggtcgtggacgagcactgcggctaccgcgggccgtccctgcggaccaccaccgtgacgggcaagatcatccacgagtggtgctgccgcagctgcaccctgccgcccctgcggttccgcggggaggacggctgctggtacgggatggagatccggcccgtcaaggagaaggaggagaacctggtgcgctccatggtgagcgcgggctccggcgagatggacagcttcagcctcgggatcctgtgcgtctccatcctgatcgaggaggtgatgcggagccgctggtcccggaagatgctcatgaccggcaccctggccgtgttcctgctcctgatcatggggcagctgacgtggaacgacctcatccgcctgtgcatcatggtcggcgccaacgccagcgacaagatggggatgggcaccacctacctggccctcatggcgaccctgaagatgcgcccgatgttcgccgtgggcctcctcttccggcgcctgacgtcccgggaggtgctgctcctgaccgtcgggctgagcctcgtggcctccgtcgagctgcccaacagcctggaggagctcggcgacgggctggccatgggcatcatgatgctgaagctcctgaccgacttccagccccaccagctgtggaccacgctcctgtccctgaccttcatccgcaccagcctctccctggactacgcctggaagaccatggcgatggccctgagcatcgtgtccctcttccccctgtgcctgagcacgacctcccagaagaccacctggctcccggtgctgctgggcagcttcgggtgcaagcccctcacgatgttcctgatcaccgagaacaagatctggggccggaagtcctggcccatcaacgaggggatcatggccgtcggcatcgtgagcatcctgctctccagcctgctgaagaacgacgtgcccctcgccgggccgctgatcgcgggcggcatgctgatcgcctgctacgtcatcagcgggtccagcgccgacctctccctggagaaggccgccgaggtgagctgggaggaggaggcggagcactccggcaccagccacaacatcctggtggaggtccaggacgacgggaccatgaagatcaaggacgaggagcgcgacgacaccctcacgatcctgctgaaggccaccctcctggccgtgtccggcgtgtaccccatgagcatccccgccaccctgttcgtctggtacttctggcagaagaagaagcagcggtccggggtgctgtgggacacccccagcccgcccgaggtggagcgcgccgtcctcgacgacggcatctaccggatcctgcagcgcggcctgctcgggcggtcccaggtgggcgtgggggtcttccaggacggcgtgttccacacgatgtggcacgtgacccgcggggcggtcctgatgtaccagggcaagcggctggagcccagctgggcctccgtgaagaaggacctcatcagctacggcgggggctggcgcttccaggggtcctggaacaccggcgaggaggtgcaggtcatcgccgtggagcccgggaagaacccgaagaacgtgcagaccacgcccggcaccttcaagacccccgagggcgaggtcggggccatcgccctggacttcaagcccggcaccagcgggtccccgatcgtgaaccgggagggcaagatcgtgggcctgtacgggaacggcgtcgtgacgaccagcgggacctacgtgtccgcgatcgcccaggccaaggccacccaggagggccccctccccgagatcgaggacgaggtcttcaagaagcgcaacctgacgatcatggacctgcacccggggagcggcaagacccggcgctacctccccgccatcgtgcgggaggcgatcaagcgcaagctgcggaccctgatcctcgcccccacccgcgtggtcgccagcgagatggccgaggcgctgaagggcatgcccatccgctaccagacgaccgccgtgaagtccgagcacaccgggcgggagatcgtggacctgatgtgccacgccaccttcacgatgcgcctcctgagcccggtccgggtgcccaactacaacatgatcatcatggacgaggcccacttcaccgaccccgcctccatcgcggcccgcggctacatcagcacccgggtggggatgggcgaggccgccgccatcttcatgaccgcgacgcccccggggtccgtcgaggccttcccccagagcaacgccgtgatccaggacgaggagcgcgacatccccgagcggtcctggaacagcggctacgactggatcaccgacttccccggcaagaccgtgtggttcgtcccgtccatcaagagcgggaacgacatcgccaactgcctgcgcaagaacggcaagcgggtgatccagctctcccgcaagaccttcgacacggagtaccagaagaccaagaacaacgactgggactacgtggtcaccaccgacatcagcgagatgggggccaacttccgggcggaccgcgtgatcgacccccggcgctgcctgaagcccgtgatcctgaaggagggccccgagcgggtcatcctcgccgggccgatgcccgtgacggtcgcctccgccgcgcagcgccggggccgcatcggccggaaccagaacaaggagggggaccagtacatctacatgggccagcccctgaacaacgacgaggaccacgcccactggaccgaggccaagatgctgctcgacaacatcaacacccccgaggggatcatcccggccctgttcgagcccgagcgcgagaagtccgccgcgatcgacggcgagtaccgcctgcgcggggaggcccgcaagaccttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggacgaaggagggcgagcgcaagaagctgcggccccgctggctggacgcccggacctacagcgacccgctcgccctgcgcgagttcaaggagttcgcggccgggcggcgctccgtcagcggcgacctgatcctcgagatcggcaagctgccccagcacctgaccctccgggcccagaacgccctggacaacctggtgatgctccacaacagcgagcagggcgggaaggcctaccgccacgcgatggaggagctgcccgacaccatcgagaccctgatgctcctggccctgatcgccgtgctcaccggcggggtcaccctgttcttcctgtccgggaaggggctcggcaagaccagcatcgggctgctgtgcgtgatggcctccagcgcgctcctgtggatggcctccgtggagccccactggatcgccgccagcatcatcctggagttcttcctcatggtcctgctgatcccggagcccgaccggcagcgcacgccccaggacaaccagctcgcctacgtggtgatcggcctgctgttcatgatcctcacggtcgcggccaacgagatggggctgctggagaccaccaagaaggacctcggcatcgggcacgtggccgtggagaaccaccaccacgccaccatgctggacgtcgacctgcggccggcctccgcgtggacgctctacgccgtggccaccaccgtgatcacccccatgatgcgccacacgatcgagaacaccaccgccaacatcagcctgaccgccatcgcgaaccaggccgccatcctgatgggcctcgacaagggctggcccatctccaagatggacatcggggtccccctgctggccctcggctgctacagccaggtgaacccgctgacgctgaccgccgcggtgctcatgctggtcgcccactacgccatcatcgggcccggcctgcaggccaaggcgacccgggaggcccagaagcgcaccgccgccgggatcatgaagaaccccacggtggacggcatcgtgaccatcgacctcgaccccgtcgtgtacgacgccaagttcgagaagcagctgggccagatcatgctgctcatcctgtgcacctcccagatcctgctcatgcgcaccacgtgggcgctgtgcgagagcatcaccctggccaccgggccgctcaccacgctgtgggagggctcccccgggaagttctggaacaccaccatcgccgtgagcatggccaacatcttccggggctcctacctggccggcgcggggctcgccttcagcctgatgaagtccctgggcgggggccgccgggggaccggcgcccagggcgagacgctcggggagaagtggaagcgccagctgaaccagctgagcaagtccgagttcaacacctacaagaagtccggcatcatggaggtcgaccggagcgaggccaaggaggggctgaagcgcggcgagaccaccaagcacgccgtgtcccgggggacggcgaagctccgctggttcgtggagcggaacctggtcaagcccgagggcaaggtgatcgacctgggctgcgggcgcggcgggtggagctactactgcgccggcctcaagaaggtgaccgaggtcaaggggtacaccaagggcggccccgggcacgaggagccgatccccatggccacctacggctggaacctggtgaagctgcactccgggaaggacgtgttcttcacgccgcccgagaagtgcgacacgctcctgtgcgacatcggcgagagctccccgaaccccaccatcgaggaggggcggaccctgcgcgtcctcaagatggtggagccctggctgcggggcaaccagttctgcatcaagatcctgaacccctacatgccgagcgtggtcgagaccctcgagcagatgcagcgcaagcacggcgggatgctggtgcggaaccccctgtcccgcaacagcacgcacgagatgtactgggtgtcctgcggcaccgggaacatcgtcagcgccgtgaacatgacctcccggatgctcctgaaccgcttcaccatggcgcaccggaagcccacgtacgagcgcgacgtggacctgggcgccggcacccgccacgtcgccgtggagcccgaggtggccaacctcgacatcatcgggcagcggatcgagaacatcaagaacgagcacaagagcacctggcactacgacgaggacaacccgtacaagacctgggcctaccacggctcctacgaggtcaagcccagcgggtccgcgagctccatggtgaacggcgtcgtgcgcctgctgacgaagccctgggacgtgatccccatggtcacccagatcgccatgaccgacaccacgccgttcgggcagcagcgggtgttcaaggagaaggtggacacccgcacgccccgggccaagcgcggcaccgcccagatcatggaggtcacggccaagtggctctggggcttcctgagccggaacaagaagccccgcatctgcacccgggaggagttcacccgcaaggtgcggtccaacgcggccatcggggccgtgttcgtcgacgagaaccagtggaacagcgccaaggaggccgtggaggacgagcgcttctgggacctggtgcaccgggagcgcgagctccacaagcagggcaagtgcgcgacctgcgtctacaacatgatggggaagcgggagaagaagctgggcgagttcgggaaggccaagggcagccgcgccatctggtacatgtggctgggcgcccggttcctcgagttcgaggcgctggggttcatgaacgaggaccactggttctcccgcgagaacagcctgtccggcgtggagggggagggcctccacaagctggggtacatcctgcgggacatcagcaagatcccgggcggcaacatgtacgccgacgacacggccgggtgggacacccgcatcaccgaggacgacctccagaacgaggccaagatcaccgacatcatggagcccgagcacgccctgctggcgacgtccatcttcaagctcacctaccagaacaaggtggtccgggtgcagcgccccgccaagagcggcaccgtgatggacgtcatctcccgccgggaccagcgcgggagcggccaggtgggcacctacgggctgaacacgttcaccaacatggaggtgcagctgatccggcagatggagtccgagggcatcttcagcccctccgagctcgagaccccgaacctggccaagaaggtcctggactggctcgagaagcacggggccgagcgcctgaagcggatggccatcagcggcgacgactgcgtggtgaagcccatcgacgaccgcttcgcgaccgccctgacggccctcaacgacatggggaaggtccggaaggacatcccccagtgggagccctccaagggctggaacgactggcagcaggtcccgttctgcagccaccacttccaccagctgatcatgaaggacggccgcgagatcgtggtcccctgccggaaccaggacgagctggtggggcgcgcccgggtgtcccagggcgccgggtggagcctccgcgagaccgcgtgcctgggcaagtcctacgcccagatgtggcagctgatgtacttccaccggcgcgacctccggctggccgccaacgccatctgcagcgcggtccccgtggactgggtgcccaccagccgcaccacctggtccatccacgcccaccaccagtggatgacgaccgaggacatgctgagcgtctggaaccgggtgtggatcgaggagaacccgtggatggaggacaagacccacgtgtccagctgggaggaggtcccctacctcgggaagcgcgaggaccagtggtgcggctccctgatcggcctgaccgcccgggccacgtgggcgaccaacatccaggtggccatcaaccaggtgcgccgcctcatcgggaacgagaactacctggactacatgaccagcatgaagcggttcaagaacgagtccgaccccgagggcgccctgtggtga

SEQ ID NO: 7938 - RNA, 9879 nt, synthetic construct
  misc_feature 1..9879: note = derived and/or modified CDS sequence (opt1) from DENV-1__KF184975__SS-prME
  source 1..9879: mol_type = other RNA
agcgtgaccatgctgctgatgctgatgcccaccgccctggccttccacctcaccacccggggcggggagccccacatgatcgtgagcaagcaggagcggggcaagagcctgctgttcaagacctccgcgggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctgacgtgcgccaagttcaagtgcgtgaccaagctggagggcaagatcgtccagtacgagaacctcaagtacagcgtgatcgtgaccgtccacaccgaggaccagcaccaggtgggcaacgagacgaccgagcacgggaccatcgcgaccatcacgccccaggcccccacgtccgagatccagctgaccgactacggcgccctgaccctcgactgcagcccccgcaccgggctggacttcaacgagatggtcctgctcacgatgaaggagaagtcctggctggtgcacaagcagtggttcctggacctccccctgccctggaccagcggcgccagcacctcccaggagacctggaaccggcaggacctgctcgtgacgttcaagaccgcccacgcgaagaagcaggaggtcgtggtgctggggagccaggagggcgccatgcacaccgccctgaccggcgccacggagatccagacctccgggaccaccacgatcttcgccggccacctcaagtgccgcctgaagatggacaagctgaccctcaaggggatgagctacgtcatgtgcaccggctccttcaagctggagaaggaggtggcggagacccagcacgggacggtgctggtccaggtgaagtacgagggcaccgacgccccctgcaagatccccttcagcatccaggacgagaagggcgtgatccagaacgggcggctgatcaccgccaacccgatcgtcaccgacaaggagaagcccgtgaacatcgagacggagccgcccttcggcgagtcctacatcgtggtcggggccggcgagaagaccctcaagctgagctggttcaagaagggctccagcatcgggaagatgttcgaggcgaccgcccgcggcgcccggcgcatggccatcctgggggacaccgcctgggacttcggctccatcgggggcgtgttcacgagcgtgggcaagctcgtccaccaggtgttcgggaccgcgtacggcgtgctgttctccggggtcagctggaccatgaagatcggcatcgggatcctgctcacctggctgggcctgaactcccgcagcacgtccctcagcatgacctgcatcgccgtgggcatggtgaccctgtacctgggggtcatggtgcaggccgactccggctgcgtgatcaactggaaggggcgggagctcaagtgcggcagcgggatcttcgtcaccaacgaggtgcacacgtggaccgagcagtacaagttccaggccgacagcccgaagcgcctgtccgccgcgatcggcaaggcctgggaggagggcgtgtgcgggatccggagcgccacccgcctggagaacgtcatgtggaagcagatctccaacgagctcaaccacatcctgctggagaacgacatgaagttcaccgtggtggtcggcgacgtgaacgggatcctcgcccagggcaagaagatggtgcggccccagcccatggagcacaagtacagctggaagtcctgggggaaggccaagatcatcggcgcggacatccagaacaccacgttcatcatcgacggccccgacaccccggagtgccccgacgaccagcgcgcctggaacatctgggaggtcgaggactacgggttcggcatcttcaccaccaacatctggctgaagctgcgggacagctacacgcagatgtgcgaccaccgcctcatgtccgccgccatcaaggacagcaaggcggtgcacgccgacatggggtactggatcgagtccgagaagaacgagacctggaagctggcccgggccagcttcatcgaggtgaagacctgcatctggcccaagtcccacaccctgtggagcaacggcgtcctcgagtccgagatgatcatccccaagatctacggcgggccgacgagccagcacaactaccgccccggctacttcacccagaccgccgggccctggcacctgggcaagctggagctcgacttcgacctgtgcgaggggaccacggtggtggtcgacgagcactgcggcaaccggggcccgtccctgcgcaccaccaccgtgacggggaagatcatccacgagtggtgctgccggagctgcaccctgccgcccctccgcttcaagggcgaggacgggtgctggtacggcatggagatccggcccgtgaaggagaaggaggagaacctggtccgctccatggtgagcgcggggagcggcgaggtggacaacttctccctcggcctgctgtgcgtcagcatcatggtggaggaggtgatgcggtcccgctggagccggaagatgctcatgaccgggaccctggccgtcttcctgctcctgatcatgggccagctgacgtggaacgacctcatccgcctgtgcatcatggtgggggccaacgcctccgaccgcatgggcatggggaccacctacctggccctcatggcgaccttcaagatgcggccgatgttcgccgtcggcctgctgttccgccggctcacgagccgcgaggtgctgctgctcaccatcggcctgtccctggtggccagcgtcgagctccccaactccctggaggagctgggggacggcctcgccatggggatcatgatgctgaagctgctcaccgacttccagagccaccagctgtggaccacgctgctctccctgaccttcgtgaagaccaccctgagcctcgactacgcctggaagacgatggcgatggtgctgtccatcgtcagcctgttccccctctgcctgtccaccaccagccagaagaccacgtggctgcccgtgctcctgggctccttcggctgcaagccgctgaccatgttcctcatcaccgagaacaagatctgggggcggaagtcctggcccctgaacgagggcatcatggccgtggggatcgcctccatcctgctcagcagcctgctgaagaacgacgtccccctcgccggccccctgatcgccggcgggatgctgatcgcctgctacgtgatctccgggagctccgccgacctcagcctggagaaggccgccgaggtgtcctgggaggaggaggcggagcacagcggggcctcccacaacatcctggtcgaggtgcaggacgacggcaccatgaagatcaaggacgaggagcgcgacgacaccctcacgatcctgctgaaggccaccctcctggccgtgagcggggtctacccgatgtccatccccgccaccctgttcgtgtggtacttctggcagaagaagaagcagcggagcggcgtgctctgggacacccccagcccgcccgaggcggagaaggccgtcctggacgacgggatctaccgcatcctgcagcggggcctgctcggccgcagccaggtgggggtgggcgtcttccaggacggggtgttccacacgatgtggcacgtgacccggggcgccgtcctgatgtaccaggggaagcgcgtggagccctcctgggccagcgtgaagaaggacctgatctcctacggcggcgggtggcggttccagggcctctggaacaccggggaggaggtccaggtgatcgccgtggagcccggcaagaacccccgcaacgtccagaccacgcccgggaccttcaagacccccgagggcgaggtgggcgcgatcgccctggacttcaagcccgggaccagcggctcccccatcgtgaaccgggaggggaagatcgtcggcctgtacggcaacggggtggtgacgaccagcggcacctacgtctccgccatcgcccaggccaaggcgagccaggaggggccgctccccgagatcgaggacgaggtgttccgcaagcggaacctgaccatcatggacctgcaccccggcagcgggaagacgcgccggtacctcccggccatcgtgcgcgaggccatcaagcggaagctgcgcaccctgatcctcgcccccacccgcgtcgtggcgtccgagatggccgaggccctgaagggcatgcccatccggtaccagaccacggccgtgaagaccgagcacaccggccgcgagatcgtcgacctgatgtgccacgccaccttcacgatgcggctcctgagccccgtgcgcgtgccgaactacaacatgatcatcatggacgaggcgcacttcaccgaccccgcctccatcgccgcccgggggtacatcagcacccgcgtcggcatgggggaggccgcggccatcttcatgaccgccacgccgcccggctccatggaggccttcccgcagagcaacgccgtgatccaggacgaggagcgggacatccccgagcgctcctggaacagcgggtacgactggatcaccgacttccccggcaagaccgtgtggttcgtcccctccatcaagagcggcaacgacatcgcgaactgcctgcggaagaacgggaagcgcgtgatccagctctcccggaagaccttcgacacggagtaccagaagaccaagaacaacgactgggactacgtggtcaccaccgacatcagcgagatgggcgccaacttccgcgccgaccgggtgatcgacccgcgccggtgcctgaagcccgtcatcctgaaggacgggcccgagcgcgtgatcctcgccggccccatgccggtgacggtcgcgtccgccgcccagcggcgcgggcggatcggccgcaaccagaacaaggagggcgaccagtacgtgtacatggggcagcccctgaacaacgacgaggaccacgcccactggaccgaggccaagatgctgctcgacaacatcaacacccccgagggcatcatccccgcgctgttcgagccggagcgcgagaagtccgccgccatcgacggggagtaccggctgcgcggcgaggcccggaagaccttcgtggagctcatgcgccgcggggacctgcccgtctggctgtcctacaaggtggccagcgagggcttccagtactccgaccgccggtggtgcttcgacggcgagcgcaacaaccaggtgctcgaggagaacatggacgtcgagatctggacgaaggagggggagcggaagaagctgcgcccccggtggctggacgcgcgcacctacagcgaccccctcgccctgcgggagttcaaggagttcgccgccggccgccggtccgtgagcggggacctgatcctcgagatcggccgcctgccgcagcacctgaccctcaaggcccagaacgcgctggacaacctggtgatgctccacaacagcgagcagggcgggaaggcctaccggcacgccatggaggagctgcccgacaccatcgagaccctgatgctcctggccctgatcgcggtcctcacgggcggggtgaccctgttcttcctgtccggcaaggggctcggcaagaccagcatcggcctgctgtgcgtgatggcctccagcgtcctcctgtggatggcctccgtggagccccactggatcgccgccagcatcatcctggagttcttcctcatggtgctgctgatccccgagccggaccgccagcggacgccccaggacaaccagctcgcgtacgtcgtgatcgggctgctgttcatcatcctcacggtggccgccaacgagatgggcctgctggagaccaccaagaaggacctcgggatcggccacgtcgccgccgaggaccaccagcacgcgaccatgctggacgtggacctgcgccccgcctccgcctggacgctctacgccgtggccaccaccatcatcaccccgatgatgcggcacacgatcgagaacaccaccgcgaacatcagcctgaccgccatcgccaaccaggccgccatcctgatggggctcgacaagggctggcccatctccaagatggacatcggcgtccccctgctggcgctcgggtgctacagccaggtgaaccccctgacgctgaccgccgccgtgctcatgctggtcgcccactacgcgatcatcggcccggggctgcaggccaaggccacccgcgaggcccagaagcgcaccgccgcgggcatcatgaagaaccccacggtggacgggatcgtggccatcgacctcgaccccgtcgtgtacgacaccaagttcgagaagcagctgggccagatcatgctgctcatcctgtgcacctcccagatcctgctcatgcggaccacgtgggccctgtgcgagagcatcaccctggccaccggccccctcaccacgctgtgggaggggtccccgggcaagttctggaacaccaccatcgccgtgagcatggcgaacatcttccgcgggtcctacctggccggcgccggcctcgccttcagcctgatgaagtccctcgggggcgggcggcgcgggaccggggcccagggcgagacgctcggcgagaagtggaagcggcagctgaaccagctgagcaagtccgagttcaacacctacaagcgcagcgggatcaccgaggtcgaccggagcgaggcgaaggagggcctcaagcgcggggagaccacgaagcacgccgtgtcccggggcgccgccaagctgcgctggttcgtggagcggaacctggtcaagcccgaggggaaggtgatcgacctgggctgcggccgcgggggctggagctactactgcgcggggctcaagaaggtgaccgaggtcaagggctacaccaagggcgggcccggccacgaggagcccatcccgatggccacctacgggtggaacctggtgaagctgcactccggcaaggacgtgttcttcatcccgcccgagaagtgcgacaccctcctgtgcgacatcggggagagctcccccaacccgacgatcgaggagggccggaccctgcgcgtcctcaagatggtggagccctggctgcgggggaaccagttctgcatcaagatcctgaacccctacatgcccagcgtggtcgagaccctcgagcagatgcagcgcaagcacggcggcatgctggtgcggaacccgctgtcccgcaacagcacccacgagatgtactgggtgtcctgcgggacgggcaacatcgtcagcgccgtgaacatgacctcccggatgctcctgaaccgcttcaccatggcccaccgcaagcccacctacgagcgggacgtggacctgggggccggcacgcgccacgtcgcggtggagcccgaggtcgccaacctcgacatcatcggccagcggatcgagaacatcaagaacgagcacaagagcacctggcactacgacgaggacaacccctacaagacctgggcctaccacgggtcctacgaggtgaagccgagcggctccgccagctccatggtgaacggggtcgtgcgcctgctgaccaagccctgggacgtgatccccatggtcacgcagatcgccatgaccgacaccacccccttcggccagcagcgggtgttcaaggagaaggtggacacgcgcaccccgcgggcgaagcgcgggaccgcccagatcatggaggtcaccgccaagtggctctggggcttcctgagccggaacaagaagccccgcatctgcacgcgggaggagttcacccgcaaggtgcggtccaacgccgccatcggcgcggtgttcgtcgacgagaaccagtggaacagcgccaaggaggccgtggaggacgagcgcttctgggacctggtgcaccgggagcgcgagctccacaagcaggggaagtgcgcgacctgcgtctacaacatgatgggcaagcgggagaagaagctgggggagttcggcaaggcgaaggggagccgcgccatctggtacatgtggctgggcgcccggttcctcgagttcgaggccctgggcttcatgaacgaggaccactggttctcccgcgagaacagcctgtccggggtggagggcgaggggctccacaagctgggctacatcctgcgggacatcagcaagatccccgggggcaacatgtacgccgacgacaccgcgggctgggacacgcgcatcaccgaggacgacctccagaacgaggccaagatcaccgacatcatggagccggagcacgccctgctggccacctccatcttcaagctcacgtaccagaacaaggtggtccgcgtgcagcggcccgccaagagcgggaccgtgatggacgtcatctcccgccgggaccagcgcggcagcggccaggtgggcacctacggcctgaacaccttcacgaacatggaggtgcagctgatccggcagatggagtccgaggggatcttcctccccagcgagctggagacccccaacctggcggagcgcgccctcgactggctggagaagcacggcgtcgagcggctgaagcgcatggccatctccggggacgactgcgtggtgaagccgaccgacgaccggttcgccaccgccctcacggcgctgaacgacatgggcaaggtccgcaaggacatcccccagtgggagcccagcaaggggtggaacgactggcagcaggtccccttctgctcccaccacttccaccagctgatcatgaaggacggccgggagatcgtggtcccgtgccgcaaccaggacgagctcgtgggccgggcccgcgtgagccagggggccggctggtccctgcgggagaccgcctgcctgggcaagagctacgcccagatgtggcagctcatgtacttccaccgccgggacctgcgcctggcggccaacgccatctgctccgccgtccccgtggactgggtgcccaccagccggaccacctggagcatccacgcgcaccaccagtggatgacgaccgaggacatgctctccgtctggaaccgcgtgtggatcgaggagaacccctggatggaggacaagacccacgtgagctcctgggaggacgtcccgtacctgggcaagcgcgaggaccagtggtgcgggagcctgatcggcctcaccgcccgggccacgtgggccaccaacatccaggtggccatcaaccaggtgcgccggctgatcggcaacgagaactacctggactacatgacctccatgaagcgcttcaagaacgagagcgaccccgagggggcgctctggtga

SEQ ID NO: 7939 - RNA, 9879 nt, synthetic construct
  misc_feature 1..9879: note = derived and/or modified CDS sequence (opt1) from DENV-1__KT831765__SS-prME
  source 1..9879: mol_type = other RNA
agcgtgaccatgctcctcatgctgatgcccaccgccctggccttccacctcaccacccggggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgccccacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaaccaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgctaccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcaccctggccgtgttcttcctgctcatcatggggcagctgacgtggaacgacctgatccgcctctgcatcatggtcggcgcgaacgccagcgaccgcatggggatgggcaccacctacctggccctgatggccaccttcaagatgcggccgatgttcgccgtgggcctcctgttccgccggctgacgtcccgcgaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccggaagtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccgtgtccggcgtgtacccgctgagcatccccgccacgctgttcgtctggtacttctggcagaagaagaagcagcggtccggggtgctctgggacacccccagcccgcccgaggtggagcgcgccgtcctggacgacggcatctaccggatcatgcagcgcggcctgctggggcggtcccaggtgggcgtgggggtcttccaggagaacgtgttccacaccatgtggcacgtgacccgcggcgcggtcctcatgtaccaggggaagcggctggagcccagctgggcctccgtgaagaaggacctgatcagctacggcggcgggtggcgcctccagggctcctggaacacgggggaggaggtgcaggtcatcgccgtggagcccggcaagaaccccaagaacgtgcagaccgcccccgggaccttcaagacccccgagggcgaggtcggcgccatcgcgctggacttcaagcccgggacgagcggctcccccatcgtgaaccgggaggggaagatcgtgggcctgtacggcaacggggtcgtgaccaccagcggcacctacgtgagcgccatcgcccaggccaaggcgtcccaggaggggccgctccccgagatcgaggacgaggtcttccgcaagcggaacctgacgatcatggacctgcaccccggcagcgggaagacccgccggtacctcccggccatcgtgcgcgaggccatcaagcggaagctgcgcaccctgatcctcgcccccacccgcgtggtcgcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtccgggtgccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtcgaggccttcccgcagagcaacgccgtgatccaggacgaggagcgcgacatccccgagcggtcctggaacagcgggtacgagtggatcaccgacttccccggcaagaccgtgtggttcgtcccctccatcaagagcggcaacgacatcgccaactgcctgcgcaagaacgggaagcgggtgatccagctctcccgcaagaccttcgacacggagtaccagaagaccaagaacaacgactgggactacgtggtcaccaccgacatcagcgagatgggcgcgaacttccgggccgaccgcgtgatcgacccgcggcgctgcctgaagcccgtgatcctgaaggacgggcccgagcgggtcatcctcgccggccccatgccggtgacggtcgcctccgccgcgcagcgccgggggcgcatcggccggaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgcgagaagtccgccgcgatcgacggggagtaccgcctgcggggcgaggcccgcaagaccttcgtggagctcatgcggcgcggggacctgcccgtgtggctgtcctacaaggtcgccagcgagggcttccagtacagcgaccggcgctggtgcttcgacggcgagcggaacaaccaggtgctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtctccggggacctgatcctcgagatcggcaagctgccgcagcacctgacccagcgggcccagaacgccctcgacaacctggtgatgctgcacaacagcgagcagggcgggcgcgcgtaccggcacgccatggaggagctccccgacaccatcgagacgctgatgctgctcgccctgatcgccgtgctgaccggcggggtcaccctcttcttcctgtccggcaaggggctgggcaagaccagcatcggcctcctgtgcgtgatggcctccagcgtgctgctctggatggcgtccgtcgagccccactggatcgccgccagcatcatcctggagttcttcctgatggtgctcctgatccccgagccggaccgccagcggacgccccaggacaaccagctggcctacgtggtcatcgggatgctgttcatgatcctgacggtggccgcgaacgagatgggcctgctcgagaccaccaagaaggacctggggatcggccacgtggccgtcgagaaccaccaccacgccgccatgctggacgtggacctccaccccgcctccgcgtggaccctgtacgccgtggccacgaccatcatcaccccgatgatgcgccacaccatcgagaacacgaccgccaacatcagcctgaccgccatcgcgaaccaggccgccatcctcatggggctggacaagggctggcccatctccaagatggacatcggcgtccccctgctcgccctggggtgctacagccaggtgaaccccctgaccctcacggcggccgtgctgatgctggtcgcccactacgccatcatcggcccggggctccaggccaaggcgacccgggaggcccagaagcgcaccgccgccggcatcatgaagaaccccaccgtggacgggatcgtggccatcgacctggaccccgtcgtgtacgacgcgaagttcgagaagcagctgggccagatcatgctcctgatcctgtgcacgtcccagatcctcctgatgcgcaccacctgggccctgtgcgagagcatcaccctcgccacgggccccctgaccaccctgtgggaggggtccccgggcaagttctggaacaccacgatcgccgtgagcatggccaacatcttccgggggtcctacctcgcgggcgccggcctggccttcagcctgatgaagtccctcgggggcgggcgccggggcaccggggcccagggcgagaccctgggcgagaagtggaagcgccagctgaaccagctctccaagagcgagttcaacacctacaagcggtccgggatcatggaggtcgaccgcagcgaggcgaaggagggcctgaagcgcggggagacgaccaagcacgccgtgtcccgcggcaccgccaagctgcggtggttcgtggagcgcaacctcgtcaagcccgaggggaaggtgatcgacctgggctgcggccgcggcgggtggagctactactgcgccgggctgaagaaggtgaccgaggtcaaggggtacacgaagggcggccccggccacgaggagcccatcccgatggccacctacgggtggaacctggtgaagctccactccggcaaggacgtgttcttcgtgccgcccgagaagtgcgacaccctgctgtgcgacatcggggagagctcccccaacccgaccatcgaggagggccgcacgctccgggtgctgaagatggtggagccctggctgcgcgggaaccagttctgcatcaagatcctcaacccctacatgcccagcgtcgtggagaccctggagcagatgcagcggaagcacggcggcatgctggtgcgcaacccgctctcccggaacagcacccacgagatgtactgggtctcctgcgggaccggcaacatcgtgagcgcgatcaacatgacctcccgcatgctgctgaaccggttcacgatggcccaccgcaagcccacctacgagcgcgacgtggacctcggggccggcacccggcacgtcaccgtggagcccgaggtggccaacctggacatcatcggccagcgcatcgagaacatcaagtgcgagcacaagagcacgtggcactacgacgaggacaacccctacaagacctgggcctaccacgggtcctacgaggtcaagccgagcggctccgcgagcagcatggtgaacggggtcgtgaagctgctcaccaagccctgggacgtgatccccatggtcacccagatcgccatgacggacaccacccccttcggccagcagcgggtgttcaaggagaaggtggacacccgcacgccgaaggccaagcgggggaccgcccagatcatggaggtcaccgcccgctggctgtggggcttcctgtcccggaacaagaagccccgcatctgcacccgggaggagttcacgcgcaaggtgcggagcaacgcggccatcggcgccgtgttcgtcgacgagaaccagtggaactccgccaaggaggcggtggaggacgagcgcttctgggacctcgtgcaccgggagcgcgagctgcacaagcaggggaagtgcgcgacctgcgtctacaacatgatgggcaagcgggagaagaagctgggggagttcggcaaggccaaggggagccgcgccatctggtacatgtggctcggcgcccggttcctggagttcgaggcgctgggcttcatgaacgaggaccactggttctcccgcgagaacagcctctccggggtggagggcgaggggctgcacaagctgggctacatcctccgggacatcagcaagatctccgggggcaacatgtacgccgacgacaccgccggctgggacacccgcatcacggaggacgacctgcagaacgaggccaagatcaccgagatcatggagcccgagcacgcccagctggcgaaggccatcttcaagctcacctaccagaacaaggtggtccgggtgcagcgcccggccaagaacgggaccgtgatggacgtcatcagccgccgggaccagcgcggctccggccaggtggggacgtacggcctgaacaccttcaccaacatggaggcccagctgatccggcagatggagagcgaggggatcttctcccccagcgagctcgagacccccaacctggccgagcgcgtgctggactggctcgagaagtacggcgtcgagcggctgaagcgcatggcgatctccggggacgactgcgtggtgaagcccatcgacgaccggttcgccacggccctgaccgccctcaacgacatgggcaaggtccgcaaggacatcccgcagtgggagcccagcaaggggtggaacgactggcagcaggtccccttctgctcccaccacttccaccagctgatcatgaaggacggccgggagatcgtggtcccctgccgcaaccaggacgagctggtgggccgggcccgcgtgagccagggggcgggctggagcctccgggagaccgcctgcctggggaagtcctacgcccagatgtggcagctgatgtacttccaccgccgggacctccgcctggccgcgaacgccatctgcagcgccgtcccggtggactgggtgcccacctcccggacgacctggagcatccacgcccaccaccagtggatgaccaccgaggacatgctgtccgtctggaaccgcgtgtggatcgaggagaacccctggatggaggacaagacgcacatcagctcctgggaggacgtgccctacctcggcaagcgggaggaccagtggtgcgggagcctgatcggcctgaccgcccgcgcgacctgggccaccaacatccaggtcgccatcaaccaggtgcgccggctcatcggcaacgagaactacctggactacatgacctccatgaagcgcttcaagaacgagagcgacccggagggggccctgtggtga

SEQ ID NO: 7940 - RNA, 9879 nt, synthetic construct
  misc_feature 1..9879: note = derived and/or modified CDS sequence (opt1) from DENV-1__KP188567__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgtgggggtgaacatgtgcaccctgatcgcgatggacctgggcgagctctgcgaggacacgatgacctacaagtgcccccggatcaccgaggccgagcccgacgacgtcgactgctggtgcaacgccaccgacacctgggtgacctacgggacctgcagccagaccggcgagcaccggcgggacaagcggtccgtggccctggcgccccacgtcggcctggggctcgagacgcgcaccgagacctggatgagctccgagggcgcgtggaagcagatccagaaggtggagacctgggccctgcggcaccccgggttcacggtgatcgccctgttcctcgcccacgcgatcggcaccagcatcacccagaaggggatcatcttcatcctgctgatgctcgtcaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccatcctccgcaagctgtgcatcgaggcgaagatcagcaacaccaccacggactcccggtgccccacccagggcgaggccaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgccaccatcacgccccaggcgcccacgagcgagatccagctgaccgactacggggccctcaccctggactgcagcccccggaccggcctggacttcaacgagatggtcctcctgacgatgaaggagaagtcctggctggtgcacaagcagtggttcctcgacctgcccctgccctggacctccggggccagcaccagccaggagacctggaaccgccaggacctcctggtgacgttcaagaccgcccacgccaagaagcaggaggtcgtggtgctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtcatgtgcaccgggagcttcaagctggagaaggaggtggccgagacccagcacggcacggtgctggtccaggtgaagtacgagggcaccgacgcgccctgcaagatccccttcctcacccaggacgagaagggggtgacccagaacggccgcctgatcacggccaacccgatcgtcaccgacaaggagaagcccgtgaacatcgagaccgagccgcccttcggggagtcctacatcgtggtcggcgccggcgagaaggccctgaagctcagctggttcaagaaggggtccagcatcggcaagatgttcgaggcgaccgcccgcggggcccgccggatggccatcctgggcgacacggcctgggacttcgggtccatcggcggcctgttcaccagcgtggggaagctcatccaccaggtgttcggcaccgcgtacggggtcctgttctccggcgtgagctggaccatgaagatcgggatcggcatcctgctcacgtggctgggcctgaactcccgcagcacctccctcagcatgacctgcatcgccgtggggatggtcaccctgtacctgggcgtgatggtgcaggccgactccgggtgcgtcatcaactggaagggccgcgagctcaagtgcgggagcggcatcttcgtgacgaacgaggtgcacacctggaccgagcagtacaagttccaggccgactccccgaagcggctgagcgccgcgatcggcaaggcctgggaggagggggtctgcggcatccgcagcgccacccggctggagaacatcatgtggaagcagatctccaacgagctcaactacatcctgctggagaacgacatgaagttcaccgtggtggtcggggacgtgaacggcatcctcgcccaggggaagaagatgatcaagccccagcccatggagcacaagtacagctggaagtcctggggcaaggccaagatcatcggcgcggacatccagaacacgaccttcatcatcgacgggcccgacaccccggagtgccccgacgaccagcgcgcctggaacatctgggaggtggaggactacggcttcgggatcttcaccacgaacatctggctgaagctgcgggacagccacacccagatgtgcgaccaccgcctcatgtccgccgccatcaaggacagcaaggcggtccacgccgacatgggctactggatcgagtccgagaagaacgagacctggaagctggcccgggccagcttcatcgaggtgaagacctgcatctggcccaagtcccacacgctgtggagcaacggcgtgctcgagtccgagatggtcatccccaagatctacgggggcccgatcagccagcacaactaccgccccgggtacttcacccagaccgccggcccctggcacctggggaagctggagctcgacttcgacctgtgcgagggcaccacggtggtggtcgacgagcactgcggctaccgggggccgtccctgcgcaccaccaccgtgacgggcaagatcatccacgagtggtgctgccggagctgcaccctgccgcccctgcgcttccgcggggaggacggctgctggtacgggatggagatccgccccgtgaaggagaaggaggagaacctggtccggtccatggtgagcgcgggctccggcgaggtggacagcttcagcctcgggatcctgtgcgtctccatcctgatcgaggaggtgatgcgcagccggtggtcccgcaagatgctcatgaccggcaccctggccgtgttcctgctcctgatcatggggcagctgacgtggaacgacctcatccggctgtgcatcatggtcggcgccaacgccctggaccgcatggggatgggcaccacctacctcgccctgatggccaccttcaagatgcgcccgatgttcgccgtggggctcctcttccggcgcctgacgagccgggaggtgctgctcctgaccgtcgggctgtccctcgtggccagcgtcgagctgccctccagcctggaggagctcggcgacgggctggccatgggcatcatgatgctgaagctcctgaccgacttccagccccaccagctgtggaccacgctcctgtccctgaccttcatccgcaccagcctctccctggactacgcctggaagaccatggcgatggccctgagcatcgtgtccctcttccccctgtgcctgagcacgacctcccagaagaccacctggctcccggtgctgctgggcagcttcgggtgcaagcccctcacgatgttcctgatcaccgagaacaagatctggggccggaagtcctggcccatcaacgaggggatcatggccgtcggcatcgtgagcatcctgctctccagcctgctgaagaacgacgtgcccctcgccgggccgctgatcgcgggcggcatgctgatcgcctgctacgtcatcagcgggtccagcgccgacctctccctggagaaggccgccgaggtgagctgggaggaggaggcggagcactccggcaccagccacaacatcctggtggaggtccaggacgacgggaccatgaagatcaaggacgaggagcgcgacgacaccctcacgatcctgctgaaggccaccctcctggccgtgtccggcgtgtaccccatgagcatccccgccaccctgttcgtctggtacttctggcagaagaagaagcagcggtccggggtgctgtgggacacccccagcccgcccgaggtggagcgcgccgtcctcgacgacggcatctaccggatcctgcagcgcggcctgctcgggcggtcccaggtgggcgtgggggtcttccaggacggcgtgttccacacgatgtggcacgtgacccgcggggcggtcctgatgtaccagggcaagcggctggagcccagctgggcctccgtgaagaaggacctcatcagctacggcgggggctggcgcttccaggggtcctggaacaccggcgaggaggtgcaggtcatcgccgtggagcccgggaagaacccgaagaacgtgcagaccacgcccggcaccttcaagacccccgagggcgaggtcggggccatcgccctggacttcaagcccggcaccagcgggtccccgatcgtgaaccgggagggcaagatcgtgggcctgtacgggaacggcgtcgtgacgaccagcgggacctacgtgtccgcgatcgcccaggccaaggccacccaggagggcacgctccccgagatcgaggacgaggtcttcaagaagcgcaacctgaccatcatggacctgcaccccgggagcggcaagacccggcgctacctcccggccatcgtgcgggaggcgatcaagcgcaagctgcggaccctgatcctcgcccccacgcgcgtggtcgccagcgagatggccgaggcgctgaagggcatgcccatccgctaccagaccaccgccgtgaagtccgagcacaccgggcgggagatcgtggacctgatgtgccacgccacgttcaccatgcgcctcctgagccccgtccgggtgccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtcgaggccttcccgcagagcaacgccgtgatccaggacgaggagcgcgacatccccgagcggtcctggaacagcggctacgactggatcaccgacttccccggcaagaccgtgtggttcgtcccctccatcaagagcgggaacgacatcgccaactgcctgcgcaagaacggcaagcgggtgatccagctctcccgcaagacgttcgacaccgagtaccagaagaccaagaacaacgactgggactacgtggtcaccacggacatcagcgagatgggggccaacttccgggcggaccgcgtgatcgacccgcggcgctgcctgaagcccgtgatcctgaaggagggccccgagcgggtcatcctcgccgggcccatgccggtgaccgtcgcctccgccgcgcagcgccggggccgcatcggccggaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgcgagaagtccgccgcgatcgacggcgagtaccgcctgcgcggggaggcccgcaagacgttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacctacagcgaccccctcgccctgcgcgagttcaaggagttcgcggccgggcggcgctccgtcagcggcgacctgatcctcgagatcggcaagctgccgcagcacctgaccctccgggcccagaacgccctggacaacctggtgatgctccacaacagcgagcagggcgggaaggcctaccgccacgcgatggaggagctgcccgacaccatcgagacgctgatgctcctggccctgatcgccgtgctcaccgggggcgtcaccctgttcttcctgtccgggaagggcctcggcaagaccagcatcgggctgctgtgcgtgatggcctccagcgcgctcctgtggatggcctccgtggagccccactggatcgccgccagcatcatcctggagttcttcctcatggtcctgctgatccccgagccggaccggcagcgcacgccccaggacaaccagctcgcctacgtggtgatcggcctgctgttcatgatcctcaccgtcgcggccaacgagatggggctgctggagaccaccaagaaggacctcggcatcgggcacgtggccgtggagaaccaccaccacgccacgatgctggacgtcgacctgcggcccgcctccgcgtggaccctctacgccgtggccaccaccgtgatcacgccgatgatgcgccacaccatcgagaacaccaccgccaacatcagcctgacggccatcgcgaaccaggccgccatcctgatgggcctcgacaagggctggcccatctccaagatggacatcggggtccccctgctggccctcggctgctacagccaggtgaaccccctgaccctgaccgccgcggtgctcatgctggtcgcccactacgccatcatcgggccgggcctgcaggccaaggcgacccgggaggcccagaagcgcacggccgccgggatcatgaagaaccccaccgtggacggcatcgtgaccatcgacctcgaccccgtcgtgtacgacgccaagttcgagaagcagctgggccagatcatgctgctcatcctgtgcacctcccagatcctgctcatgcgcacgacctgggcgctgtgcgagagcatcaccctggccaccgggcccctcacgaccctgtgggagggctccccggggaagttctggaacaccaccatcgccgtgagcatggccaacatcttccggggctcctacctggccggcgcggggctcgccttcagcctgatgaagtccctgggcgggggccgccgggggacgggcgcccagggcgagaccctcggggagaagtggaagcgccagctgaaccagctgagcaagtccgagttcaacacctacaagaagtccggcatcatggaggtcgaccggagcgaggccaaggaggggctgaagcgcggcgagaccacgaagcacgccgtgtcccgggggaccgcgaagctccgctggttcgtggagcggaacctggtcaagcccgagggcaaggtgatcgacctgggctgcgggcgcggcgggtggagctactactgcgccggcctcaagaaggtgaccgaggtcaaggggtacaccaagggcggccccgggcacgaggagcccatcccgatggccacctacggctggaacctggtgaagctgcactccgggaaggacgtgttcttcacgccgcccgagaagtgcgacaccctcctgtgcgacatcggcgagagctcccccaacccgaccatcgaggaggggcggaccctgcgcgtcctcaagatggtggagccctggctgcggggcaaccagttctgcatcaagatcctgaacccctacatgcccagcgtggtcgagacgctcgagcagatgcagcgcaagcacggcgggatgctggtgcggaacccgctgtcccgcaacagcacccacgagatgtactgggtgtcctgcggcaccgggaacatcgtcagcgccgtgaacatgacctcccggatgctcctgaaccgcttcacgatggcgcaccggaagcccacctacgagcgcgacgtggacctgggcgccggcacccgccacgtcgccgtggagcccgaggtggccaacctcgacatcatcgggcagcggatcgagaacatcaagaacgagcacaagagcacctggcactacgacgaggacaacccctacaagacgtgggcctaccacggctcctacgaggtcaagccgagcgggtccgcgagctccatggtgaacggcgtcgtgcgcctgctgaccaagccctgggacgtgatccccatggtcacccagatcgccatgaccgacacgacccccttcgggcagcagcgggtgttcaaggagaaggtggacacccgcaccccgcgggccaagcgcggcacggcccagatcatggaggtcaccgccaagtggctctggggcttcctgagccggaacaagaagccccgcatctgcacccgggaggagttcacccgcaaggtgcggtccaacgcggccatcggggccgtgttcgtcgacgagaaccagtggaacagcgccaaggaggccgtggaggacgagcgcttctgggacctggtgcaccgggagcgcgagctccacaagcagggcaagtgcgcgacgtgcgtctacaacatgatggggaagcgggagaagaagctgggcgagttcgggaaggccaagggcagccgcgccatctggtacatgtggctgggcgcccggttcctcgagttcgaggcgctggggttcatgaacgaggaccactggttctcccgcgagaacagcctgtccggcgtggagggggagggcctccacaagctggggtacatcctgcgggacatcagcaagatccccggcggcaacatgtacgccgacgacaccgccgggtgggacacccgcatcaccgaggacgacctccagaacgaggccaagatcacggacatcatggagccggagcacgccctgctggcgacctccatcttcaagctcacctaccagaacaaggtggtccgggtgcagcgccccgccaagagcggcaccgtgatggacgtcatctcccgccgggaccagcgcgggagcggccaggtgggcacgtacgggctgaacaccttcaccaacatggaggtgcagctgatccggcagatggagtccgagggcatcttcagcccctccgagctcgagacccccaacctggccaagaaggtcctggactggctcgagaagcacggggccgagcgcctgaagcggatggccatcagcggcgacgactgcgtggtgaagccgatcgacgaccgcttcgcgacggccctgaccgccctcaacgacatggggaaggtccggaaggacatcccccagtgggagccctccaagggctggaacgactggcagcaggtccccttctgcagccaccacttccaccagctgatcatgaaggacggccgcgagatcgtggtcccgtgccggaaccaggacgagctggtggggcgcgcccgggtgtcccagggcgccgggtggagcctccgcgagaccgcgtgcctgggcaagtcctacgcccagatgtggcagctgatgtacttccaccggcgcgacctccggctggccgccaacgccatctgcagcgcggtccccgccgactgggtgcccaccagccgcaccacgtggtccatccacgcccaccaccagtggatgaccaccgaggacatgctgagcgtgtggaaccgggtctggatcgaggagaacccctggatggaggacaagacccacgtgtccagctgggaggaggtgccgtacctcgggaagcgcgaggaccagtggtgcggctccctgatcggcctgacggcccgggcgacctgggccaccaacatccaggtcgccatcaaccaggtgcgccgcctcatcgggaacgagaactacctggactacatgaccagcatgaagcggttcaagaacgagtccgaccccgagggcgccctgtggtga

SEQ ID NO: 7941 - RNA, 9879 nt, synthetic construct
  misc_feature 1..9879: note = derived and/or modified CDS sequence (opt1) from DENV-1__KP188568__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgtgggggtgaacatgtgcaccctgatcgcgatggacctgggcgagctctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtcggcctggggctcgagacgcgcaccgagacctggatgagctccgagggcgcgtggaagcagatccagaaggtggagacctgggccctgcggcaccccgggttcacggtgatcgccctgttcctcgcccacgcgatcggcaccagcatcacccagaaggggatcatcttcatcctgctgatgctcgtgaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgccccacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttcctcacccaggacgagaagggggtcacccagaacggccgcctgatcacggccaacccgatcgtgaccgacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcccgccggatggccatcctgggcgacacggcctgggacttcgggtccatcggcggcctgttcaccagcgtggggaagctcatccaccaggtcttcggcaccgcgtacggggtgctgttctccggcgtgagctggaccatgaagatcgggatcggcatcctgctcacgtggctgggcctgaactcccgcagcacctccctcagcatgacctgcatcgccgtcgggatggtgaccctgtacctgggcgtgatggtccaggccgactccgggtgcgtgatcaactggaagggccgcgagctcaagtgcgggagcggcatcttcgtgacgaacgaggtccacacctggaccgagcagtacaagttccaggccgactccccgaagcggctgagcgccgcgatcggcaaggcctgggaggagggggtgtgcggcatccgcagcgccacccggctggagaacatcatgtggaagcagatctccaacgagctcaaccacatcctgctggagaacgacatgaagttcaccgtggtcgtgggggacgtgaacggcatcctcgcccaggggaagaagatgatccgcccccagcccatggagcacaagtacagctggaagtcctggggcaaggccaagatcatcggcgcggacatccagaacacgaccttcatcatcgacgggcccgacaccccggagtgccccgacgaccagcgggcctggaacatctgggaggtcgaggactacggcttcgggatcttcaccacgaacatctggctgaagctgcgcgacagccacacccagatgtgcgaccaccggctcatgtccgccgccatcaaggacagcaaggcggtgcacgccgacatgggctactggatcgagtccgagaagaacgagacctggaagctggcccgcgccagcttcatcgaggtgaagacctgcatctggcccaagtcccacacgctgtggagcaacggcgtcctcgagtccgagatggtgatccccaagatctacgggggcccgatcagccagcacaactaccggcccgggtacttcacccagaccgccggcccctggcacctggggaagctggagctcgacttcgacctgtgcgagggcaccacggtggtcgtggacgagcactgcggctaccgcgggccgtccctgcggaccaccaccgtgacgggcaagatcatccacgagtggtgctgccgcagctgcaccctgccgcccctgcggttccgcggggaggacggctgctggtacgggatggagatccggcccgtcaaggagaaggaggagaacctggtgcgctccatggtgagcgcgggctccggcgagatggacagcttcagcctcgggatcctgtgcgtctccatcctgatcgaggaggtgatgcggagccgctggtcccggaagatgctcatgaccggcaccctggccgtgttcttcctgctcatcatggggcagctgacgtggaacgacctgatccgcctctgcatcatggtcggcgccaacgccagcgaccgcatggggatgggcaccacctacctggccctgatggccaccttcaagatgcggccgatgttcgccgtggggctcctgttccgccggctgacgtcccgcgaggtgctcctgctgaccgtcgggctcagcctggtggcctccgtcgagctgcccaacagcctcgaggagctgggcgacgggctggccatgggcatcatgatgctcaagctgctgaccgacttccagccccaccagctctggaccacgctgctgtccctcaccttcatccggaccagcctgtccctggactacgcctggaagaccatggcgatggccctcagcatcgtgtccctgttccccctgtgcctcagcacgacctcccagaagaccacctggctgccggtgctgctcggcagcttcgggtgcaagcccctgacgatgttcctgatcaccgagaacaagatctggggccgcaagtcctggcccatcaacgaggggatcatggccgtcggcatcgtgagcatcctcctgtccagcctgctcaagaacgacgtgcccctggccgggccgctgatcgcgggcggcatgctcatcgcctgctacgtcatcagcgggtccagcgccgacctgtccctggagaaggccgccgaggtgagctgggaggaggaggcggagcactccggcaccagccacaacatcctcgtggaggtccaggacgacgggaccatgaagatcaaggacgaggagcgggacgacaccctgacgatcctgctcaaggccaccctgctggccgtgtccggcgtgtaccccatgagcatccccgccaccctcttcgtctggtacttctggcagaagaagaagcagcgctccggggtgctgtgggacacccccagcccgcccgaggtggagcgggccgtcctggacgacggcatctaccgcatcctgcagcggggcctcctggggcgctcccaggtgggcgtgggggtcttccaggacggcgtgttccacacgatgtggcacgtgacccgcggggcggtcctgatgtaccagggcaagcgcctcgagcccagctgggcctccgtgaagaaggacctgatcagctacggcgggggctggcggttccaggggtcctggaacaccggcgaggaggtgcaggtcatcgccgtggagcccgggaagaacccgaagaacgtgcagaccacgcccggcaccttcaagacccccgagggcgaggtcggggccatcgccctggacttcaagcccggcaccagcgggtccccgatcgtgaaccgcgagggcaagatcgtgggcctctacgggaacggcgtcgtgacgaccagcgggacctacgtgtccgcgatcgcccaggccaaggccacccaggagggccccctgcccgagatcgaggacgaggtcttcaagaagcggaacctgacgatcatggacctccacccggggagcggcaagacccgccggtacctgcccagcatcgtgcgcgaggccatcaagcggaagctgcgcaccctcatcctggcgcccacccgcgtggtcgcctccgagatggccgaggccctgaagggcatgcccatccggtaccagacgaccgcggtcaagagcgagcacaccgggcgcgagatcgtggacctcatgtgccacgccaccttcacgatgcggctgctgtccccggtccgcgtgcccaactacaacatgatcatcatggacgaggcccacttcaccgaccccgccagcatcgccgcgcggggctacatctccacccgcgtggggatgggcgaggccgccgccatcttcatgaccgccacgcccccggggagcgtcgaggcgttcccccagtccaacgccgccatccaggacgaggagcgggacatccccgagcgcagctggaacaccggctacgactggatcaccgacttccccggcaagaccgtgtggttcgtgccgtccatcaagagcgggaacgacatcgccaactgcctccggaagaacggcaagcgcgtcatccagctgtcccggaagacgttcgacaccgagtaccagaagaccaagaacaacgactgggactacgtggtgaccacggacatcagcgagatgggggccaacttccgcgcggaccgggtcatcgacccccgccggtgcctgaagcccgtgatcctcaaggagggccccgagcgcgtgatcctggccgggccgatgcccgtcaccgtggcctccgccgcgcagcggcgcggccggatcggccgcaaccagaacaaggagggggaccagtacatctacatgggccagcccctgaacaacgacgaggaccacgcccactggaccgaggccaagatgctcctggacaacatcaacacccccgaggggatcatcccggccctgttcgagcccgagcgcgagaagtccgccgcgatcgacggcgagtaccggctccgcggggaggcccggaagacgttcgtcgagctgatgcgccggggcgacctgcccgtgtggctctcctacaaggtggccagcgagggcttccagtactccgaccgccggtggtgcttcgacggggagcgcaacaaccaggtcctggaggagaacatggacgtggagatctggaccaaggagggcgagcggaagaagctgcgcccccggtggctcgacgcccgcacctacagcgacccgctggccctgcgggagttcaaggagttcgcggccgggcgccggtccgtgagcggcgacctcatcctggagatcggcaagctgccccagcacctcaccctgcgcgcccagaacgccctggacaacctcgtcatgctgcacaacagcgagcagggcgggaaggcctaccggcacgcgatggaggagctgcccgacaccatcgagacgctcatgctgctggccctcatcgccgtgctgaccgggggcgtgaccctgttcttcctctccgggaagggcctgggcaagaccagcatcgggctgctctgcgtcatggcctccagcgcgctgctgtgggtggcctccgtggagccccactggatcgccgccagcatcatcctcgagttcttcctgatggtcctgctcatcccggagcccgaccgccagcggacgccccaggacaaccagctggcctacgtggtgatcggcctcctcttcatgatcctgaccgtcgcggccaacgagatggggctgctcgagaccaccaagaaggacctgggcatcgggcacgtggccgtggagaaccaccaccacgccacgatgctggacgtcgacctccgcccggcctccgcgtggaccctgtacgccgtggccaccaccgtgatcacgcccatgatgcggcacaccatcgagaacaccaccgccaacatcagcctgacggccatcgcgaaccaggccgccatcctcatgggcctggacaagggctggcccatctccaagatggacatcggggtccccctgctcgccctgggctgctacagccaggtgaacccgctgaccctcaccgccgcggtgctgatgctggtcgcccactacgccatcatcgggcccggcctccaggccaaggcgacccgcgaggcccagaagcgcacggccgccgggatcatgaagaaccccaccgtggacggcatcgtgaccatcgacctggaccccgtcgtgtacgacgccaagttcgagaagcagctgggccagatcatgctcctgatcctgtgcacctcccagatcctcctgatgcggacgacctgggcgctgtgcgagagcatcaccctcgccaccgggccgctgacgaccctgtgggagggctcccccgggaagttctggaacaccaccatcgccgtgagcatggccaacatcttccgcggctcctacctcgccggcgcggggctggccttcagcgtcatgaagtccctgggcgggggccggcgcgggacgggcgcccagggcgagaccctcggggagaagtggaagcggcagctgaaccagctgagcaagtccgagttcaacacctacaagaagtccggcatcatggaggtggaccgcagcgaggccaaggaggggctcaagcggggcgagaccacgaagcacgccgtgtcccgcgggaccgcgaagctgcggtggttcgtcgagcgcaacctggtgaagcccgagggcaaggtgatcgacctgggctgcgggcggggcgggtggagctactactgcgccggcctcaagaaggtcaccgaggtgaaggggtacaccaagggcggccccgggcacgaggagccgatccccatggccacctacggctggaacctggtgaagctgcactccgggaaggacgtcttcttcacgccgcccgagaagtgcgacaccctcctgtgcgacatcggcgagagctccccgaaccccaccatcgaggaggggcgcaccctgcgggtgctcaagatggtggagccctggctgcgcggcaaccagttctgcatcaagatcctgaacccctacatgccgagcgtcgtggagacgctcgagcagatgcagcggaagcacggcgggatgctggtgcgcaaccccctgtcccggaacagcacccacgagatgtactgggtctcctgcggcaccgggaacatcgtgagcgccgtgaacatgacctcccgcatgctcctgaaccggttcacgatggcgcaccgcaagcccacctacgagcgcgacgtcgacctgggcgccggcacccggcacgtggccgtggagcccgaggtcgccaacctcgacatcatcgggcagcgcatcgagaacatcaagaacgagcacaagagcacctggcactacgacgaggacaacccgtacaagacgtgggcctaccacggctcctacgaggtgaagcccagcgggtccgcgagctccatggtcaacggcgtggtgcggctgctgaccaagccctgggacgtcatccccatggtgacccagatcgccatgaccgacacgaccccgttcgggcagcagcgcgtgttcaaggagaaggtcgacacccggacgccccgggccaagcggggcacggcccagatcatggaggtgaccgccaagtggctctggggcttcctgagccgcaacaagaagccccggatctgcacccgcgaggagttcacccggaaggtgcgctccaacgcggccatcggggccgtcttcgtggacgagaaccagtggaacagcgccaaggaggccgtggaggacgagcggttctgggacctggtccaccgcgagcgggagctccacaagcagggcaagtgcgcgacgtgcgtgtacaacatgatggggaagcgcgagaagaagctgggcgagttcgggaaggccaagggcagccgggccatctggtacatgtggctgggcgcccgcttcctcgagttcgaggcgctggggttcatgaacgaggaccactggttctcccgggagaacagcctgtccggcgtggagggggagggcctccacaagctggggtacatcctgcgcgacatcagcaagatcccgggcggcaacatgtacgccgacgacaccgccgggtgggacacccggatcaccgaggacgacctccagaacgaggccaagatcacggacatcatggagcccgagcacgccctgctggcgacctccatcttcaagctcacctaccagaacaaggtcgtgcgcgtgcagcgccccgccaagagcggcaccgtcatggacgtgatctcccggcgcgaccagcgggggagcggccaggtgggcacgtacgggctgaacaccttcaccaacatggaggtccagctgatccgccagatggagtccgagggcatcttcagcccctccgagctcgagaccccgaacctggccaagaaggtgctggactggctcgagaagcacggggccgagcggctgaagcgcatggccatcagcggcgacgactgcgtggtcaagcccatcgacgaccggttcgcgacggccctgaccgccctcaacgacatggggaaggtgcgcaaggacatcccccagtgggagccctccaagggctggaacgactggcagcaggtcccgttctgcagccaccacttccaccagctgatcatgaaggacggccgggagatcgtcgtgccctgccgcaaccaggacgagctggtggggcgggcccgcgtctcccagggcgccgggtggagcctccgggagaccgcgtgcctgggcaagtcctacgcccagatgtggcagctgatgtacttccaccgccgggacctccgcctggccgccaacgccatctgcagcgcggtgcccgtggactgggtccccaccagccggaccacgtggtccatccacgcccaccaccagtggatgaccaccgaggacatgctgagcgtgtggaaccgcgtgtggatcgaggagaacccgtggatggaggacaagacccacgtctccagctgggaggaggtgccctacctcgggaagcgggaggaccagtggtgcggctccctgatcggcctgacggcccgcgccacctgggcgaccaacatccaggtggccatcaaccaggtccgccggctcatcgggaacgagaactacctggactacatgaccagcatgaagcgcttcaagaacgagtccgaccccgagggcgccctgtggtga

SEQ ID NO: 7942 - RNA, 9879 nt, synthetic construct
  misc_feature 1..9879: note = derived and/or modified CDS sequence (opt1) from DENV-1__KF971870__SS-prME
  source 1..9879: mol_type = other RNA
agcgtgaccatgctgctcatgctgatgcccaccgccctggccttccacctcaccacccggggcggggagccccacatgatggtgtccaagcaggagcggggcaagagcctgctgttcaagacctccgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccagcgccatcaaggactccaaggccgtgcacgccgacatgggctactggatcgagagcgagaagaacgacacctggaagctggcccgggcgtccttcatcgaggtcaagacctgcatctggcccaagagccacacgctgtggtccaacggcgtgctcgagagcgagatgatcatccccaagatctacgggggcccgatctcccagcacaactaccgccccgggtacttcacccagaccgccggcccctggcacctggggaagctggagctcgacttcgacctgtgcgagggcaccacggtggtcgtggacgagcactgcggcaaccgggggccgagcctgcgcaccaccaccgtgacgggcaagatcatccacgagtggtgctgccggtcctgcaccctgccgcccctccgcttccgcggggaggacggctgctggtacgggatggagatccgccccgtcaaggagaaggaggagaacctggtgaagtccatggtgagcgccggctccggcgaggtcgacagcttctccctcgggctgctgtgcatcagcatcatgatcgaggaggtgatgcggtcccgctggagccggaagatgctcatgatcggcaccctggccgtgttcttcctgctcatcatggggcagctgacctggaacgacctgatccgcctctgcatcatggtcggcgccaacgcgtccgaccgcatggggatgggcacgacctacctggccctgatggccaccttcaagatgcggccgatgttcgccgtgggcctcctgttccgccggctgaccagccgcgaggtgctcctgctgacgatcgggctctccctggtcgccagcgcggagctgcccaactccctcgaggagctgggcgacgggctggccatgggcatcatgatcctcaagctgctgaccgacttccagagccaccagctctgggccaccctgctgtccctcaccttcatcaagacgaccttcagcctgcactacgcctggaagaccatggcgatggtgctgtccatcgtcagcctcttccccctgtgcctgtccaccacgagccagaagaccacctggctccccgtgctgctgggctccctcgggtgcaagccgctgaccatgttcctgatcgccgagaacaagatctggggccgcaagagctggcccctcaacgaggggatcatggccgtgggcatcgtcagcatcctgctgtccagcctcctgaagaacgacgtgcccctggccgggcccctcatcgccggcggcatgctgatcgcgtgctacgtgatctccgggagctccgccgacctgagcctcgagaaggccgccgaggtctcctgggaggaggaggccgagcacagcggcgcgtcccacaacatcctggtggaggtgcaggacgacgggacgatgaagatcaaggacgaggagcgcgacgacaccctgaccatcctcctgaaggccaccctgctcgccgtcagcggcgtgttcccgctgtccatccccgccaccctgttcgtgtggtacttctggcagaagaagaagcagcggagcggggtcctctgggacacgcccagcccgcccgaggtggagcgcgccgtgctggacgacggcatctaccggatcatgcagcgcggcctgctggggcggagccaggtcggcgtgggggtgttccaggagaacgtcttccacaccatgtggcacgtgacccgcggcgcggtgctcatgtaccaggggaagcggctggagccctcctgggccagcgtcaagaaggacctgatctcctacggcggcgggtggcgcctccagggcagctggaacaccggggaggaggtccaggtgatcgccgtcgagcccggcaagaaccccaagaacgtgcagacggcccccgggaccttcaagacccccgagggcgaggtgggcgccatcgcgctggacttcaagcccgggacctccggcagccccatcgtcaaccgggaggggaagatcgtgggcctgtacggcaacggggtggtcacgaccagcggcacctacgtgtccgccatcgcccaggccaaggcgagccaggaggggccgctccccgagatcgaggacgaggtgttccgcaagcggaacctgaccatcatggacctgcaccccggctccgggaagacgcgccggtacctcccggccatcgtccgcgaggccatcaagcggaagctgcgcaccctgatcctcgcccccacccgcgtggtggccagcgagatggcggaggccctgaagggcatgcccatccggtaccagaccacggccgtcaagtccgagcacaccggcaaggagatcgtggacctgatgtgccacgccaccttcaccatgcgcctcctgagccccgtgcgggtcccgaactacaacatgatcatcatggacgaggcccacttcacggacccctccagcatcgcggcccgcgggtacatctccacccgggtgggcatgggggaggccgccgccatcttcatgaccgcgacgccgcccggcagcgtggaggccttcccgcagtccaacgccgtcatccaggacgaggagcgcgacatccccgagcggagctggaactccgggtacgagtggatcacggacttccccggcaagaccgtgtggttcgtgcccagcatcaagtccggcaacgacatcgccaactgcctgcgcaagaacgggaagcgggtcatccagctcagccgcaagaccttcgacaccgagtaccagaagacgaagaacaacgactgggactacgtggtgaccaccgacatctccgagatgggcgcgaacttccgggccgaccgcgtcatcgacccgcggcgctgcctgaagcccgtgatcctgaaggacgggcccgagcgggtgatcctcgccggccccatgccggtcaccgtggccagcgccgcgcagcgccgggggcgcatcggccggaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgcgagaagtccgccgcgatcgacggggagtaccgcctgcggggcgaggcccgcaagaccttcgtcgagctcatgcggcgcggggacctgcccgtgtggctgagctacaaggtggccagcgagggcttccagtactccgaccggcgctggtgcttcgacggcgagcggaacaaccaggtcctcgaggagaacatggacgtggagatctggaccaaggagggggagcgcgagaagctgcggccccgctggctgggcgcccggacgtacagcgaccccctcgccctgcgcgacttcaaggagttcgcggccgggcggcgctccgtgagcggcgacctgatcctcgagatcggcaagctgccgcagcacctgacccagcgggcccagaacgccctcgacaacctggtcatgctgcacaactcccagcagggcgggcgcgcgtacacccacgccatggaggagctccccgacaccatcgagacgctgatgctgctcgccctgatcgccgtgctgaccgggggcgtgaccctcttcttcctgagcgggcggggcctgggcaagacctccatcgggctcctgtgcgtcatggccagctccgtgctgctctggatggcgagcgtggagccccactggatcgccgcctccatcatcctggagttcttcctgatggtcctcctgatccccgagccggaccgccagcggacgccccaggacaaccagctggcctacgtggtgatcggcctcctgttcatgatcctgacggtcgccgcgaacgagatggggctcctggagaccaccaagaaggacctgggcatcgggcacgtggccgtggagaaccaccaccacgccgccatgctcgacgtcgacctgcaccccgccagcgcgtggaccctgtacgccgtggccacgaccatcatcaccccgatgatgcgccacaccatcgagaacacgaccgccaacatctccctcaccgccatcgcgaaccaggccgccatcctgatgggcctggacaagggctggcccatcagcaagatggacatcggggtgcccctcctggccctgggctgctactcccaggtcaaccccctcaccctgacggcggccgtgctgatgctcgtggcccactacgccatcatcgggccgggcctgcaggccaaggcgacccgggaggcccagaagcgcaccgccgccgggatcatgaagaaccccaccgtcgacggcatcgtggccatcgacctggaccccgtggtctacgacgcgaagttcgagaagcagctcggccagatcatgctgctgatcctctgcacgagccagatcctgctgatgcgcaccacctgggccctctgcgagtccatcaccctggccacggggcccctgaccaccctctgggagggcagcccggggaagttctggaacaccacgatcgccgtgtccatggccaacatcttccggggcagctacctggcgggcgccgggctggccttcagcctcatgaagtccctgggcgggggccgccgggggaccggcgcccagggcgagaccctgggggagaagtggaagcgccggctcaaccagctgagcaagtccgagttcaacacctacaagcgcagcggcatcatggaggtggaccggtccgaggcgaaggaggggctgaagcgcggcgagacgaccaagcacgccgtcagccgggggaccgccaagctccgctggttcgtggagcggaacctggtgaagcccgagggcaaggtcatcgacctgggctgcgggcgcggcgggtggtcctactactgcgccggcctgaagaaggtgaccgaggtgaaggggtacacgaagggcggccccgggcacgaggagcccatcccgatggccacctacggctggaacctcgtcaagctgcacagcgggaaggacgtgttcttcatcccgcccgagaagtgcgacaccctgctctgcgacatcggcgagtccagccccaacccgaccatcgaggaggggcggacgctgcgcgtgctgaagatggtcgagccctggctccggggcaaccagttctgcatcaagatcctgaacccctacatgccctccgtggtggagaccctggagcagatgcagcgcaagcacggcgggatgctcgtccggaacccgctgagccgcaactccacccacgagatgtactgggtgagctgcggcaccgggaacatcgtgtccgcggtcaacatgaccagccggatgctgctcaaccgcttcacgatggcccaccgcaagcccacctacgagcgggacgtggacctgggcgccggcacccgccacgtggccgtcgagcccgaggtggccaacctggacatcatcgggcagcggatcgagaacatcaagcacgagcacaagtccacctggcactacgacgaggacaacccctacaagacgtgggcgtaccacggcagctacgaggtgaagccgtccgggagcgccagctccatggtcaacggcgtggtcaagctcctgaccaagccctgggacgtgatccccatggtgacccagatcgccatgaccgacacgacccccttcgggcagcagcgcgtcttcaaggagaaggtggacacccggaccccgaaggccaagcgcggcacggcccagatcatggaggtgaccgcgcggtggctgtggggcttcctcagccgcaacaagaagccccggatctgcacccgcgaggagttcacccggaaggtccgctccaacgccgccatcggggccgtgttcatcgacgagaaccagtggaacagcgcgaaggaggccgtggaggacgagcggttctgggacctggtccaccgcgagcgggagctgcacaagcagggcaagtgcgccacgtgcgtgtacaacatgatggggaagcgcgagaagaagctcggcgagttcgggaaggccaagggctcccgggccatctggtacatgtggctgggcgcgcgcttcctggagttcgaggccctcgggttcatgaacgaggaccactggttcagccgggagaactccctgagcggcgtggagggggagggcctgcacaagctcgggtacatcctgcgcgacatctccaagatccccggcggcaacatgtacgccgacgacaccgccgggtgggacacccggatcaccgaggacgacctgcagaacgaggccaagatcacggacatcatggagccggagcacgcgctcctggccaaggccatcttcaagctgacctaccagaacaaggtcgtgcgcgtgcagcgccccgccaagaacggcaccgtcatggacgtgatcagccggcgcgaccagcgggggtccggccaggtgggcacctacgggctcaacacgttcaccaacatggaggcccagctgatccgccagatggagagcgagggcatcttctcccccagcgagctggagacccccaacctcgcggagcgggtcctggactggctggggaagtacggcgtggagcgcctcaagcggatggccatctccggggacgactgcgtggtcaagccgatcgacgaccgcttcgccaccgccctgacggccctgaacgacatgggcaaggtgcggaaggacatcccccagtgggagcccagcaagggctggaacgactggcagcaggtccccttctgctcccaccacttccaccagctcatcatgaaggacgggcgcgagatcgtcgtgccgtgccggaaccaggacgagctggtgggccgcgcgcgggtcagccagggggccggctggagcctgcgcgagaccgcctgcctcgggaagtcctacgcccagatgtggcagctgatgtacttccaccggcgcgacctgcggctcgcggccaacgccatctgcagcgccgtgcccgtggactgggtccccacctcccgcaccacgtggagcatccacgcccaccaccagtggatgaccaccgaggacatgctgtccgtgtggaaccgggtgtggatcgaggagaacccctggatggaggacaagacccacatcagcaactgggaggacgtcccgtacctgggcaagcgcgaggaccagtggtgcggctccctcatcgggctgacggcgcgcgccacctgggccaccaacatccaggtggccatcaaccaggtgcggcgcctgatcggcaacgagaactacctcgactacatgaccagcatgaagcggttcaagaacgagtccgaccccgagggggccctgtggtga

SEQ ID NO: 7943 - RNA, 9879 nt, synthetic construct
  misc_feature 1..9879: note = derived and/or modified CDS sequence (opt1) from DENV-1__KF971871__SS-prME
  source 1..9879: mol_type = other RNA
agcgtgaccatgctgctcatgctgatgcccaccgccctggccttccacctcaccacccggggcggggagccccacatgatggtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtggagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgacacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgatcggcaccctggccgtgttcttcctgctcatcatggggcagctgacctggaacgacctgatccgcctctgcatcatggtcggcgcgaacgccagcgaccgcatggggatgggcacgacctacctggccctgatggccaccttcaagatgcggccgatgttcgccgtgggcctcctgttccgccggctgacctcccgcgaggtgctcctgctgacgatcgggctcagcctggtcgcgtccgccgagctgcccaacagcctcgaggagctgggcgacgggctggccatgggcatcatgatcctcaagctgctgaccgacttccagtcccaccagctctgggccaccctgctgagcctcaccttcatcaagacgaccttctccctgcactacgcgtggaagaccatggccatggtgctgagcatcgtctccctcttccccctgtgcctgagcaccacgtcccagaagaccacctggctccccgtgctgctgggcagcctcgggtgcaagccgctgaccatgttcctgatcgccgagaacaagatctggggccggaagtcctggcccctcaacgaggggatcatggccgtgggcatcgtcagcatcctgctgagctccctcctgaagaacgacgtgcccctggccgggcccctcatcgcgggcggcatgctgatcgcctgctacgtgatcagcgggtccagcgccgacctgtccctcgagaaggccgccgaggtcagctgggaggaggaggcggagcactccggcgccagccacaacatcctggtggaggtgcaggacgacgggacgatgaagatcaaggacgaggagcgcgacgacaccctgaccatcctcctgaaggccaccctgctcgccgtctccggcgtgttcccgctgagcatccccgccaccctgttcgtgtggtacttctggcagaagaagaagcagcggtccggggtcctctgggacacgcccagcccgcccgaggtggagcgcgcggtgctggacgacggcatctaccggatcatgcagcgcggcctgctggggcggtcccaggtcggcgtgggggtgttccaggagaacgtcttccacaccatgtggcacgtgacccgcggcgccgtgctcatgtaccaggggaagcggctggagcccagctgggcctccgtcaagaaggacctgatcagctacggcggcgggtggcgcctccagggctcctggaacaccggggaggaggtccaggtgatcgccgtcgagcccggcaagaaccccaagaacgtgcagacggcccccgggaccttcaagacccccgagggcgaggtgggcgcgatcgccctggacttcaagcccgggaccagcggctcccccatcgtcaaccgggaggggaagatcgtgggcctgtacggcaacggggtggtcacgaccagcggcacctacgtgagcgccatcgcccaggcgaaggcctcccaggaggggccgctccccgagatcgaggacgaggtgttccgcaagcggaacctgaccatcatggacctgcaccccggcagcgggaagacgcgccggtacctcccggccatcgtccgcgaggccatcaagcggaagctgcgcaccctgatcctcgcccccacccgcgtggtggcgtccgagatggccgaggccctgaagggcatgcccatccggtaccagaccacggccgtcaagagcgagcacaccggcaaggagatcgtggacctgatgtgccacgccaccttcaccatgcgcctcctgtcccccgtgcgggtcccgaactacaacatgatcatcatggacgaggcgcacttcacggaccccagctccatcgccgcccgcgggtacatcagcacccgggtgggcatgggggaggccgccgcgatcttcatgaccgccacgccgcccggctccgtggaggccttcccgcagagcaacgccgtcatccaggacgaggagcgcgacatccccgagcggtcctggaacagcgggtacgagtggatcacggacttccccggcaagaccgtgtggttcgtgccctccatcaagagcggcaacgacatcgcgaactgcctgcgcaagaacgggaagcgggtcatccagctctcccgcaagaccttcgacaccgagtaccagaagacgaagaacaacgactgggactacgtggtgaccaccgacatcagcgagatgggcgccaacttccgggccgaccgcgtcatcgacccgcggcgctgcctgaagcccgtgatcctgaaggacgggcccgagcgggtgatcctcgccggccccatgccggtcaccgtggcctccgcggcccagcgccgggggcgcatcggccggaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgcgagaagtccgcggccatcgacggggagtaccgcctgcggggcgaggcccgcaagaccttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggaccaaggagggggagcgcaagaagctgcggccccgctggctgggcgcccggacgtactccgaccccctcgcgctgcgcgagttcaaggagttcgccgccgggcggcgcagcgtgtccggcgacctgatcctcgagatcggcaagctgccgcagcacctgacccagcgggcccagaacgcgctcgacaacctggtcatgctgcacaacagcgagcagggcgggcgcgcctaccggcacgccatggaggagctccccgacaccatcgagaccctgatgctgctcgccctgatcgccgtgctgaccggcggggtgaccctcttcttcctgtccgggcgcgggctgggcaagaccagcatcgggctcctgtgcgtcatggcgtccagcgtgctgctctggatggcctccgtggagccccactggatcgccgccagcatcatcctggagttcttcctgatggtcctcctgatccccgagccggaccggcagcgcacgccccaggacaaccagctggcctacgtggtgatcggcctcctgttcatgatcctgaccgtcgcggccaacgagatggggctcctggagacgaccaagaaggacctgggcatcgggcacgtggccgtggagaaccaccaccacgccgccatgctcgacgtcgacctgcaccccgcgtccgcctggaccctgtacgccgtggccaccacgatcatcaccccgatgatgcggcacaccatcgagaacaccacggccaacatcagcctcaccgcgatcgccaaccaggccgccatcctgatgggcctggacaagggctggcccatctccaagatggacatcggggtgcccctcctggcgctgggctgctacagccaggtcaaccccctcaccctgaccgccgccgtgctgatgctcgtggcccactacgccatcatcgggccgggcctgcaggcgaaggccacgcgcgaggcccagaagcgcaccgccgccgggatcatgaagaaccccaccgtcgacggcatcgtggcgatcgacctggaccccgtggtctacgacgccaagttcgagaagcagctcggccagatcatgctgctgatcctctgcacctcccagatcctgctgatgcggacgacctgggccctctgcgagagcatcaccctggccaccgggcccctgacgaccctctgggagggctccccggggaagttctggaacaccaccatcgccgtgagcatggcgaacatcttccgcggctcctacctggccggcgccgggctggccttcagcctcatgaagtccctgggcgggggccggcgcgggacgggcgcgcagggcgagaccctgggggagaagtggaagcggcgcctcaaccagctgtccaagagcgagttcaacacctacaagcggtccggcatcatggaggtggaccgcagcgaggccaaggaggggctgaagcggggcgagaccacgaagcacgccgtctcccgcgggaccgccaagctccggtggttcgtggagcgcaacctggtgaagcccgagggcaaggtcatcgacctgggctgcgggcggggcgggtggagctactactgcgccggcctgaagaaggtgaccgaggtgaaggggtacaccaagggcggccccgggcacgaggagcccatcccgatggcgacgtacggctggaacctcgtcaagctgcactccgggaaggacgtgttcttcatcccgcccgagaagtgcgacaccctgctctgcgacatcggcgagagctcccccaacccgaccatcgaggaggggcgcaccctgcgggtgctgaagatggtcgagccctggctccgcggcaaccagttctgcatcaagatcctgaacccctacatgcccagcgtggtggagacgctggagcagatgcagcggaagcacggcgggatgctcgtccgcaacccgctgtcccggaacagcacccacgagatgtactgggtgtcctgcggcaccgggaacatcgtgagcgccgtcaacatgacctcccgcatgctgctcaaccgcttcaccatggcccaccggaagcccacgtacgagcgcgacgtggacctgggcgccggcacccggcacgtggccgtcgagcccgaggtggcgaacctggacatcatcgggcagcgcatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctcctgacgaagccctgggacgtgatccccatggtgacccagatcgccatgaccgacaccacgcccttcgggcagcagcgggtcttcaaggagaaggtggacacccgcaccccgaaggccaagcggggcaccgcgcagatcatggaggtgacggcccgctggctgtggggcttcctctcccggaacaagaagccccgcatctgcacccgggaggagttcacccgcaaggtccggagcaacgccgccatcggggcggtgttcatcgacgagaaccagtggaactccgccaaggaggccgtggaggacgagcgcttctgggacctggtccaccgggagcgcgagctgcacaagcagggcaagtgcgcgacctgcgtgtacaacatgatggggaagcgggagaagaagctcggcgagttcgggaaggccaagggcagccgcgcgatctggtacatgtggctgggcgcccggttcctggagttcgaggccctcgggttcatgaacgaggaccactggttctcccgcgagaacagcctgtccggcgtggagggggagggcctgcacaagctcgggtacatcctgcgggacatcagcaagatccccggcggcaacatgtacgccgacgacacggccgggtgggacacccgcatcaccgaggacgacctgcagaacgaggcgaagatcaccgacatcatggagccggagcacgccctcctggccaaggccatcttcaagctgacgtaccagaacaaggtcgtgcgcgtgcagcggcccgccaagaacggcaccgtcatggacgtgatctcccgccgggaccagcgcgggagcggccaggtgggcacctacgggctcaacaccttcacgaacatggaggcgcagctgatccggcagatggagtccgagggcatcttcagcccctccgagctggagacccccaacctcgccgagcgcgtcctggactggctggggaagtacggcgtggagcggctcaagcgcatggccatcagcggggacgactgcgtggtcaagccgatcgacgaccggttcgccaccgccctgaccgcgctgaacgacatgggcaaggtgcgcaaggacatcccccagtgggagccctccaagggctggaacgactggcagcaggtccccttctgcagccaccacttccaccagctcatcatgaaggacgggcgggagatcgtcgtgccgtgccgcaaccaggacgagctggtgggccgggcccgcgtctcccagggggccggctggagcctgcgggagacggcctgcctcggcaagagctacgcgcagatgtggcagctgatgtacttccaccgccgggacctgcgcctcgccgccaacgccatctgctccgccgtgcccgtggactgggtccccaccagccggaccacctggtccatccacgcgcaccaccagtggatgacgaccgaggacatgctgagcgtgtggaaccgcgtgtggatcgaggagaacccctggatggaggacaagacccacatctccaactgggaggacgtcccgtacctgggcaagcgcgaggaccagtggtgcggcagcctcatcgggctgaccgcccgggccacgtgggccaccaacatccaggtggccatcaaccaggtgcgccggctgatcggcaacgagaactacctcgactacatgacctccatgaagcgcttcaagaacgagagcgaccccgagggggcgctgtggtga

SEQ ID NO: 7944 - RNA, 9879 nt, synthetic construct
  misc_feature 1..9879: note = derived and/or modified CDS sequence (opt1) from DENV-1__KF971869__SS-prME
  source 1..9879: mol_type = other RNA
agcgtgaccatgctgctcatgctgatgcccaccgccctggccttccacctcaccacccggggcggggagccccacatgatggtgagcaagcaggagcggggcaagagcctgctgttcaagaccagcgccggggtgaacatgtgcaccctcatcgccatggacctgggcgagctgtgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgacacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgatcggcaccctggccgtgttcttcctgctcatcatggggcagctgacctggaacgacctgatccgcctctgcatcatggtcggcgcgaacgccagcgaccgcatggggatgggcacgacctacctggccctgatggccaccttcaagatgcggccgatgttcgccgtgggcctcctgttccgccggctgacctcccgcgaggtgctcctgctgacgatcgggctcagcctggtcgcgtccgccgagctgcccaacagcctcgaggagctgggcgacgggctggccatgggcatcatgatcctcaagctgctgaccgacttccagtcccaccagctctgggccaccctgctgagcctcaccttcatcaagacgaccttctccctgcactacgcgtggaagaccatggccatggtgctgagcatcgtctccctcttccccctgtgcctgagcaccacgtcccagaagaccacctggctccccgtgctgctgggcagcctcgggtgcaagccgctgaccatgttcctgatcgccgagaacaagatctggggccggaagtcctggcccctcaacgaggggatcatggccgtgggcatcgtcagcatcctgctgagctccctcctgaagaacgacgtgcccctggccgggcccctcatcgcgggcggcatgctgatcgcctgctacgtgatcagcgggtccagcgccgacctgtccctcgagaaggccgccgaggtcagctgggaggaggaggcggagcactccggcgccagccacaacatcctggtggaggtgcaggacgacgggacgatgaagatcaaggacgaggagcgcgacgacaccctgaccatcctcctgaaggccaccctgctcgccgtctccggcgtgttcccgctgagcatccccgccaccctgttcgtgtggtacttctggcagaagaagaagcagcggtccggggtcctctgggacacgcccagcccgcccgaggtggagcgcgcggtgctggacgacggcatctaccggatcatgcagcgcggcctgctggggcggtcccaggtcggcgtgggggtgttccaggagaacgtcttccacaccatgtggcacgtgacccgcggcgccgtgctcatgtaccaggggaagcggctggagcccagctgggcctccgtcaagaaggacctgatcagctacggcggcgggtggcgcctccagggctcctggaacaccggggaggaggtccaggtgatcgccgtcgagcccggcaagaaccccaagaacgtgcagacggcccccgggaccttcaagacccccgagggcgaggtgggcgcgatcgccctggacttcaagcccgggaccagcggctcccccatcgtcaaccgggaggggaagatcgtgggcctgtacggcaacggggtggtcacgaccagcggcacctacgtgagcgccatcgcccaggcgaaggcctcccaggaggggccgctccccgagatcgaggacgaggtgttccgcaagcggaacctgaccatcatggacctgcaccccggcagcgggaagacgcgccggtacctcccggccatcgtccgcgaggccatcaagcggaagctgcgcaccctgatcctcgcccccacccgcgtggtggcgtccgagatggccgaggccctgaagggcatgcccatccggtaccagaccacggccgtcaagagcgagcacaccggcaaggagatcgtggacctgatgtgccacgccaccttcaccatgcgcctcctgtcccccgtgcgggtcccgaactacaacatgatcatcatggacgaggcgcacttcacggaccccagctccatcgccgcccgcgggtacatcagcacccgggtgggcatgggggaggccgccgcgatcttcatgaccgccacgccgcccggctccgtggaggccttcccgcagagcaacgccgtcatccaggacgaggagcgcgacatccccgagcggtcctggaacagcgggtacgagtggatcacggacttccccggcaagaccgtgtggttcgtgccctccatcaagagcggcaacgacatcgcgaactgcctgcgcaagaacgggaagcgggtcatccagctctcccgcaagaccttcgacaccgagtaccagaagacgaagaacaacgactgggactacgtggtgaccaccgacatcagcgagatgggcgccaacttccgggccgaccgcgtcatcgacccgcggcgctgcctgaagcccgtgatcctgaaggacgggcccgagcgggtgatcctcgccggccccatgccggtcaccgtggcctccgcggcccagcgccgggggcgcatcggccggaaccacaacaaggagggcgaccagtacatctacatggggcagcccctgaacaacgacgaggaccacgcccactggacggaggccaagatgctgctcgacaacatcaacacccccgagggcatcatccccgccctgttcgagccggagcgcgagaagtccgcggccatcgacggggagtaccgcctgcggggcgaggcccgcaagaccttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggaccaaggagggggagcgcaagaagctgcggccccgctggctggacgcccggacgtactccgaccccctcgcgctgcgcgagttcaaggagttcgccgccggccggcgcagcgtgtccggggacctgatcctcgagatcggcaagctgccgcagcacctgacccagcgggcccagaacgcgctcgacaacctggtcatgctgcacaacagcgagcagggcgggcgcgcctaccggcacgccatggaggagctccccgacaccatcgagaccctgatgctgctcgccctgatcgccgtgctgacgggcggggtgaccctcttcttcctgtccggccgcgggctgggcaagaccagcatcggcctcctgtgcgtcatggcgtccagcgtgctgctctggatggcctccgtggagccccactggatcgccgccagcatcatcctggagttcttcctgatggtcctcctgatccccgagccggaccggcagcgcacgccccaggacaaccagctggcctacgtggtgatcgggctcctgttcatgatcctgaccgtcgcggccaacgagatgggcctcctggagacgaccaagaaggacctggggatcggccacgtggccgtggagaaccaccaccacgccgccatgctcgacgtcgacctgcaccccgcgtccgcctggaccctgtacgccgtggccaccacgatcatcaccccgatgatgcggcacaccatcgagaacaccacggccaacatcagcctcaccgcgatcgccaaccaggccgccatcctgatggggctggacaagggctggcccatctccaagatggacatcggcgtgcccctcctggcgctggggtgctacagccaggtcaaccccctcaccctgaccgccgccgtgctgatgctcgtggcccactacgccatcatcggcccggggctgcaggcgaaggccacgcgcgaggcccagaagcgcaccgccgccggcatcatgaagaaccccaccgtcgacgggatcgtggcgatcgacctggaccccgtggtctacgacgccaagttcgagaagcagctcggccagatcatgctgctgatcctctgcacctcccagatcctgctgatgcggacgacctgggccctctgcgagagcatcaccctggccaccggccccctgacgaccctctgggaggggtccccgggcaagttctggaacaccaccatcgccgtgagcatggcgaacatcttccgcgggtcctacctggccggcgccggcctggccttcagcctcatgaagtccctcgggggcgggcggcgcgggacgggggcgcagggcgagaccctgggcgagaagtggaagcggcgcctcaaccagctgtccaagagcgagttcaacacctacaagcggtccgggatcatggaggtggaccgcagcgaggccaaggagggcctgaagcgcggggagaccacgaagcacgccgtctcccgcggcaccgccaagctccggtggttcgtggagcgcaacctggtgaagcccgaggggaaggtcatcgacctgggctgcggccgcgggggctggagctactactgcgccgggctgaagaaggtgaccgaggtgaagggctacaccaagggcggccccggccacgaggagcccatcccgatggcgacgtacgggtggaacctcgtcaagctgcactccggcaaggacgtgttcttcatcccgcccgagaagtgcgacaccctgctctgcgacatcggggagagctcccccaacccgaccatcgaggagggccgcaccctgcgggtgctgaagatggtcgagccctggctccgcgggaaccagttctgcatcaagatcctgaacccctacatgcccagcgtggtggagacgctggagcagatgcagcggaagcacggcggcatgctcgtccgcaacccgctgtcccggaacagcacccacgagatgtactgggtgtcctgcgggaccggcaacatcgtgagcgccgtcaacatgacctcccgcatgctgctcaaccgcttcaccatggcccaccggaagcccacgtacgagcgcgacgtggacctgggggccggcacccggcacgtggccgtcgagcccgaggtggcgaacctggacatcatcggccagcgcatcgagaacatcaagcacgagcacaagagcacctggcactacgacgaggacaacccctacaagacctgggcctaccacgggtcctacgaggtgaagccgagcggctccgccagcagcatggtcaacggggtggtcaagctcctgacgaagccctgggacgtgatccccatggtgacccagatcgccatgaccgacaccacgcccttcggccagcagcgggtcttcaaggagaaggtggacacccgcaccccgaaggccaagcgggggaccgcgcagatcatggaggtgacggcccgctggctgtggggcttcctctcccggaacaagaagccccgcatctgcacccgggaggagttcacccgcaaggtccggagcaacgccgccatcggcgcggtgttcatcgacgagaaccagtggaactccgccaaggaggccgtggaggacgagcgcttctgggacctggtccaccgggagcgcgagctgcacaagcaggggaagtgcgcgacctgcgtgtacaacatgatgggcaagcgggagaagaagctcggggagttcggcaaggccaaggggagccgcgcgatctggtacatgtggctgggcgcccggttcctggagttcgaggccctcggcttcatgaacgaggaccactggttctcccgcgagaacagcctgtccggggtggagggcgaggggctgcacaagctcggctacatcctgcgggacatcagcaagatccccgggggcaacatgtacgccgacgacacggccggctgggacacccgcatcaccgaggacgacctgcagaacgaggcgaagatcaccgacatcatggagccggagcacgccctcctggccaaggccatcttcaagctgacgtaccagaacaaggtcgtgcgcgtgcagcggcccgccaagaacgggaccgtcatggacgtgatctcccgccgggaccagcgcggcagcggccaggtggggacctacggcctcaacaccttcacgaacatggaggcgcagctgatccggcagatggagtccgaggggatcttcagcccctccgagctggagacccccaacctcgccgagcgcgtcctggactggctgggcaagtacggggtggagcggctcaagcgcatggccatcagcggcgacgactgcgtggtcaagccgatcgacgaccggttcgccaccgccctgaccgcgctgaacgacatggggaaggtgcgcaaggacatcccccagtgggagccctccaagggctggaacgactggcagcaggtccccttctgcagccaccacttccaccagctcatcatgaaggacggccgggagatcgtcgtgccgtgccgcaaccaggacgagctggtggggcgggcccgcgtctcccagggcgccgggtggagcctgcgggagacggcctgcctcggcaagagctacgcgcagatgtggcagctgatgtacttccaccgccgggacctgcgcctcgccgccaacgccatctgctccgccgtgcccgtggactgggtccccaccagccggaccacctggtccatccacgcgcaccaccagtggatgacgaccgaggacatgctgagcgtgtggaaccgcgtgtggatcgaggagaacccctggatggaggacaagacccacatctccaactgggaggacgtcccgtacctggggaagcgcgaggaccagtggtgcggcagcctcatcggcctgaccgcccgggccacgtgggccaccaacatccaggtggccatcaaccaggtgcgccggctgatcgggaacgagaactacctcgactacatgacctccatgaagcgcttcaagaacgagagcgaccccgagggcgcgctgtggtga

SEQ ID NO: 7945 - RNA, 9879 nt, synthetic construct
  misc_feature 1..9879: note = derived and/or modified CDS sequence (opt1) from DENV-1__JN903578__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagacctccgtgggggtgaacatgtgcaccctgatcgcgatggacctgggcgagctctgcgaggacacgatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacgcgcaccgagacctggatgagctccgagggcgcctggaagcagatccagcgggtggagacctgggccctgcgccaccccgggttcacggtgatcgccctgttcctcgcccacgcgatcggcaccagcatcacccagaaggggatcatcttcatcctgctgatgctcgtcaccccctccatggccatgcggtgcgtgggcatcggcaaccgcgacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccggaagctgtgcatcgaggcgaagatcagcaacaccaccacggactcccgctgcccgacccagggcgaggccaccctggtcgaggagcaggacgccaacttcgtgtgccggcgcaccttcgtggaccggggctgggggaacggctgcggcctcttcggcaaggggagcctgctgacgtgcgccaagttcaagtgcgtcaccaagctcgagggcaaggtggtgcagtacgagaacctgaagtactccgtcatcgtgaccgtccacaccggcgaccagcaccaggtggggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtccacaagcagtggttcctcgacctgcccctgccctggacctccggggccagcaccagccaggagacctggaaccggcaggacctcctggtgacgttcaagaccgcccacgccaagaagcaggaggtggtcgtgctgggctcccaggagggcgcgatgcacaccgccctcaccggggccacggagatccagaccagcggcaccaccacgatcttcgccgggcacctgaagtgccgcctgaagatggacaagctcaccctgaagggcatgtcctacgtgatgtgcaccgggagcttcaagctggagaaggaggtcgccgagacccagcacggcacggtgctggtgcaggtcaagtacgagggcaccgacgcgccctgcaagatccccttcctcatccaggacgagaagggggtgacccagaacggccggctgatcaccgccaacccgatcgtgacggacaaggagaagcccgtcaacatcgagaccgagccgcccttcggggagtcctacatcgtggtgggcgccggcgagaaggccctgaagctcagccgcttcaagaaggggtccagcatcggcaagatgttcgaggcgaccgcccgcggggcccgccgcatggccatcctgggcgacaccgcctgggacttcgggtccatcggcggcgtcttcacgagcgtggggaagctgatccaccaggtgttcggcaccgcgtacggggtcctcttctccggcgtgagctggaccatgaagatcgggatcggcatcctgctgacctggctcggcctgaactcccggagcacgtccctgagcatgacctgcatcaccgtggggatggtcaccctctacctgggcgtgatggtgcaggccgactccgggtgcgtcatcaactggaagggccgcgagctgaagtgcgggagcggcatcttcgtgacgaacgaggtgcacacctggaccgagcagtacaagttccaggccgactccccgaagcggctcagcgccgccatcggcaaggcgtgggaggagggggtctgcggcatccgcagcgccacccggctggagaacatcatgtggaagcagatctccaacgagctgaaccacatcctcctggagaacgacatgaagttcaccgtggtggtcggggacgccaacggcatcctggcccaggggaagaagatgatccgcccccagcccatggagcacaagtacagctggaagtcctggggcaaggccaagatcatcggcgcggacatccagaacacgaccttcatcatcgacgggcccgacaccccggagtgccccgacgaccagcgggcctggaacatctgggaggtggaggactacggcttcgggatcttcaccacgaacatctggctcaagctgcgcgacagctacacccagatgtgcgaccaccggctgatgtccgccgccatcaaggacagcaaggcggtgcacgccgacatgggctactggatcgagtccgagaagaacgagacctggaagctcgcccgcgccagcttcatcgagatcaagacctgcatctggcccaagtcccacacgctgtggagcaacggcgtcctggagtccgagatgatcatccccaagatctacgggggcccgatcagccagcacaaccaccggcccgggtacttcacccagaccgccggcccctggcacctcgggaagctggagctggacttcgacgtgtgcgagggcaccacggtggtcgtggacgagcactgcggcaaccgcgggccgtccctccggaccaccaccgtgacgggcaagatcatccacgagtggtgctgccgcagctgcaccctgccgcccctgcggttccgcggggaggacggctgctggtacgggatggagatccggcccgtcaaggagaaggaggagaacctcgtgcgctccatggtgagcgcgggctccggcgaggtcgacagcttcagcctggggctgctctgcgtgtccatcatgatcgaggaggtgatgcggagccgctggtcccgcaagatgctgatgaccggcaccctggccgtcttcttcctcctgatcatggggcagctgacgtggaacgacctcatccggctgtgcatcatggtgggcgccaacgtgagcgaccgcatggggatgggcaccacctacctggccctcatggccaccttcaagatgcggccgatgttcgcggtcggcctgctgttccgccggctcacgtcccgcgaggtgctgctgctcaccatcgggctgagcctggtcgcctccgccgagctccccaacagcctggaggagctgggcgacgggctcgccatgggcatcatgatgctgaagctgctcaccgacttccagtcccaccagctgtggaccacgctgctcagcctgaccttcatcaagaccaccctgtccctcgactacgcctggaagacgatcaccatgatcctgagcatcgtgtccctgttccccctctgcctgagcaccacctcccagaagacgacctggctgcccgtgctcctgggcagcttcgggtgcaagccgctgaccatgttcctcatcaccgagaacaagatctggggccggaagtcctggcccctgaacgaggggatcatggcggtcggcatcgtgagcatcctgctctccagcctgctgaagaacgacgtgcccctcgccgggcccctgatcgccggcggcatgctgatcgcctgctacgtcatcagcgggtccagcgcggacctctccctggagaaggccgccgaggtgagctgggaggaggaggccgagcactccggcaccagccacaacatcctggtggaggtccaggacgacgggacgatgaagatcaaggacgaggagcgcgacgacaccctcaccatcctgctgaaggccaccctcctggcggtgtccggcgtgtacccgatgagcatccccgccacgctgttcgtctggtacttctggcagaagaagaagcagcggtccggggtgctctgggacacccccagcccgcccgaggtggagcgcgccgtcctggacgacggcatctaccggatcctgcagcgcggcctgctcgggcggtcccaggtgggcgtgggggtcttccaggacggcgtgttccacaccatgtggcacgtgacccgcggggccgtcctgatgtaccagggcaagcggctggagcccagctgggcctccgtgaagaaggacctcatcagctacggcgggggctggcgcttccaggggtcctggaacacgggcgaggaggtgcaggtcatcgcggtggagcccgggaagaaccccaagaacgtgcagaccacccccggcaccttcaagacgcccgagggcgaggtcggggccatcgccctggacttcaagcccggcaccagcgggtcccccatcgtgaaccgggagggcaagatcgtgggcctgtacgggaacggcgtcgtgaccaccagcgggacgtacgtgtccgccatcgcccaggcgaaggccagccaggagggcccgctccccgagatcgaggacgaggtcttcaagaagcgcaacctgaccatcatggacctgcaccccgggagcggcaagacccggcgctacctcccggccatcgtgcgggaggccatcaagcgcaagctgcgcaccctgatcctcgcccccacgcgggtggtcgcgtccgagatggccgaggccctgaagggcatgcccatccgctaccagaccaccgccgtcaagagcgagcacaccgggcgggagatcgtggacctgatgtgccacgcgacgttcaccatgcgcctcctgtcccccgtccgggtgccgaactacaacatgatcatcatggacgaggcccacttcaccgaccccgccagcatcgccgcccgcggctacatctccacccgggtggggatgggcgaggcggccgccatcttcatgacggccacgccgcccgggagcgtcgaggccttcccgcagtccaacgcggtgatccaggacgaggagaaggacatccccgagcgcagctggaactccggctacgactggatcaccgacttccccggcaagaccgtgtggttcgtccccagcatcaagtccgggaacgacatcgccaactgcctgcggaagaacggcaagcgcgtgatccagctcagccggaagacgttcgacaccgagtaccagaagaccaagaacaacgactgggactacgtggtcaccacggacatctccgagatgggggccaacttccgcgccgaccgggtgatcgacccgcgccggtgcctgaagcccgtgatcctgaaggacggccccgagcgcgtcatcctcgccgggcccatgccggtgaccgtcgcgagcgccgcccagcggcgcggccggatcggccgcaaccagaacaaggagggggaccagtacgtgtacatgggccagcccctgaacaacgacggggaccacgcccactggaccgaggcgaagatgctgctcgacaacatcaacacccccgagggcatcatccccgccctgttcgagccggagcgcgagaagtccgccgccatcgacggggagtaccggctgcgcggcgaggcccggaagacgttcgtggagctcatgcgccggggcgacctgcccgtctggctgagctacaaggtggcgtccgaggggttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacctactccgaccccctcgccctgcgggagttcaaggagttcgccgccggccgccggagcgtgagcggcgacctgatcctcgagatcgggaagctgccgcagcacctgaccctccgcgcgcagaacgccctggacaacctggtgatgctccacaactccgagcagggcgggaaggcctaccggcacgccatggaggagctgcccgacaccatcgagacgctgatgctcctggccctgatcgcggtcctcaccggcggggtgaccctgttcttcctgagcggcaagggcctcgggaagacctccatcggcctgctgtgcgtgatggccagctccgccctcctgtggatggccagcgtcgagccccactggatcgcggcctccatcatcctggagttcttcctcatggtgctgctgatccccgagccggaccgccagcggacgccccaggacaaccagctcgcctacgtggtcatcgggctgctgttcatgatcctcaccgtggccgccaacgagatgggcctgctggagaccaccaagaaggacctcgggatcggccacgtggcggccgagaaccaccaccacgccacgatgctggacgtcgacctgcgccccgccagcgcctggaccctctacgcggtggccaccaccgtgatcacgccgatgatgcggcacaccatcgagaacaccaccgccaacatctccctgacggccatcgccaaccaggcggccatcctgatgggcctcgacaaggggtggcccatcagcaagatggacatcggcgtccccctgctggccctcgggtgctactcccaggtgaaccccctgaccctgaccgccgccgtgctcatgctggtcgcgcactacgccatcatcggcccggggctgcaggccaaggccacccgcgaggcgcagaagcgcacggccgccggcatcatgaagaaccccaccgtggacggcatcgtggccatcgacctcgaccccgtcgtgtacgacgccaagttcgagaagcagctggggcagatcatgctgctcatcctgtgcaccagccagatcctgctcatgcggaccacgtgggcgctgtgcgagtccatcaccctggccaccggccccctcaccacgctgtgggaggggagcccgggcaagttctggaacaccaccatcgccgtgtccatggccaacatcttccgcggcagctacctggccggggcgggcctcgccttctccctgatgaagtccctcggcgggtcccggcgcgggaccggggcccagggcgagacgctcggggagaagtggaagcggcagctgaaccagctgagcaagagcgagttcaacacctacaagcgctccggcatcatggaggtcgaccggagcgaggccaaggaggggctcaagcgcggcgagaccaccaagcacgccgtgtcccgggggacggcgaagctgcgctggttcgtggagcggaacctggtcaagcccgagggcaaggtgatcgacctgggctgcgggcgcggcgggtggagctactactgcgccggcctcaagaaggtgaccgaggtcaaggggtacaccaagggcggccccgggcacgaggagcccatcccgatggccacctacggctggaacctggtgaagctgcactccgggaaggacgtgttcttcatcccgcccgagaagtgcgacaccctcctgtgcgacatcggcgagagctcccccaacccgacgatcgaggaggggcggaccctgcgcgtcctcaagatggtggagccctggctgcggggcaaccagttctgcatcaagatcctgaacccctacatgcccagcgtggtcgagaccctcgagcagatgcagcgcaagcacggcgggatgctggtgcggaacccgctgtcccgcaacagcacccacgagatgtactgggtgtcctgcggcacggggaacatcgtcagcgccgtgaacatgacctcccggatgctcctgaaccgcttcaccatggcgcaccgcaagcccacctacgagcgggacgtggacctgggcgccggcacgcgccacgtcgccgtggagcccgaggtggccaacctcgacatcatcgggcagcggatcgagaacatcaagaacgagcacaagagcacctggcactacgacgaggacaacccctacaagacctgggcctaccacggctcctacgaggtcaagccgagcgggtccgcgagctccatggtgaacggcgtcgtgcgcctgctgaccaagccctgggacgtgatccccatggtcacgcagatcgccatgaccgacaccacccccttcgggcagcagcgggtgttcaaggagaaggtggacacgcgcaccccgcgggccaagcgcggcaccgcccagatcatggaggtcaccgccaagtggctctggggcttcctgagccggaacaagaagccccgcatctgcacgcgggaggagttcacccgcaaggtgcggagcaacgcggccatcggggccgtgttcgtcgacgagaaccagtggaactccgccaaggaggccgtggaggacgagcgcttctgggacctggtgcaccgggagcgcgagctccacaagcagggcaagtgcgcgacctgcgtctacaacatgatggggaagcgggagaagaagctgggcgagttcgggaaggccaagggcagccgcgccatctggtacatgtggctgggcgcccggttcctcgagttcgaggcgctggggttcatgaacgaggaccactggttctcccgcgagaacagcctgtccggcgtggagggggagggcctccacaagctggggtacatcctgcgggacatcagcaagatccccggcggcaacatgtacgccgacgacaccgccgggtgggacacgcgcatcaccgaggacgacctccagaacgaggccaagatcaccgacatcatggagccggagcacgccctgctggcgacctccatcttcaagctcacgtaccagaacaaggtggtccgcgtgcagcggcccgccaagagcggcaccgtgatggacgtcatctcccgccgggaccagcgcgggagcggccaggtgggcacctacgggctgaacaccttcacgaacatggaggtgcagctgatccggcagatggagtccgagggcatcttcctccccagcgagctggagacccccaacctggccaagcgcgtcctcgactggctggagaagcacggggccgagcggctgaagcgcatggccatctccggcgacgactgcgtggtgaagccgatcgacgaccggttcgcgaccgccctcaccgccctgaacgacatggggaaggtccgcaaggacatcccccagtgggagcccagcaagggctggaacgactggcagcaggtccccttctgctcccaccacttccaccagctgatcatgaaggacggccgggagatcgtggtcccgtgccgcaaccaggacgagctcgtggggcgggcccgcgtgagccagggcgccgggtggtccctgcgggagacggcgtgcctgggcaagagctacgcccagatgtggcagctcatgtacttccaccgccgggacctgcgcctggccgccaacgccatctgcagcgcggtccccgtggactgggtgcccacctcccggaccacctggagcatccacgcccaccaccagtggatgaccacggaggacatgctctccgtctggaaccgcgtgtggatcgaggagaacccctggatggaggacaagacccacgtgagctcctgggaggaggtcccgtacctggggaagcgcgaggaccagtggtgcggcagcctgatcggcctcaccgcccgggccacctgggcgacgaacatccaggtggccatcaaccaggtgcgccggctgatcgggaacgagaactacctggactacatgaccaccatgaagcgcttcaagaacgagtccgaccccgagggcgccctctggtga

SEQ ID NO: 7946 - RNA, 9879 nt, synthetic construct
  misc_feature 1..9879: note = derived and/or modified CDS sequence (opt1) from DENV-1__JN903579__SS-prME
  source 1..9879: mol_type = other RNA
agcgtgaccatgctgctcatgctgctgcccaccgccctcgccttccacctgaccacccggggcggggagccccacatgatcgtgggcaagcaggagcggggcaagagcctgctgttcaagaccagcgccggggtgaacatgtgcaccctgatcgccatggacctgggggagctctgcgaggacaccatgacctacaagtgcccccggatcaccgaggccgagcccgacgacgtggactgctggtgcaacgccaccgacacctgggtgacctacgggacctgcagccagaccggcgagcaccggcgggacaagcggagcgtggccctggcgccccacgtggggctgggcctcgagacgcgcaccgagacctggatgtccagcgagggggcctggcggcagatccagaaggtggagacctgggccctgcgccaccccggcttcaccgtgatcgccctgttcctcgcgcacgccatcgggacctccatcacccagaagggcatcatcttcatcctgctgatgctcgtgacccccagcatggccatgcggtgcgtcggcatcgggaaccgcgacttcgtggagggcctgtccggggccacgtgggtggacgtcgtgctggagcacggcagctgcgtgaccaccatggccaagaacaagcccaccctcgacatcgagctgctgaagacggaggtcaccaaccccgcggtgctccggaagctgtgcatcgaggccaagatctccaacaccaccacggacagccgctgccccacccagggcgaggccaccctggtggaggagcaggacgccaacttcgtctgccggcgcaccttcgtggaccgggggtggggcaacgggtgcggcctcttcgggaagggctccctgctgacgtgcgccaagttcaagtgcgtgaccaagctcgagggcaagatcgtccagtacgagaacctgaagtacagcgtgatcgtgaccgtccacaccggggaccagcaccaggtgggcaacgagacgaccgagcacgggaccatcgcgaccatcacgccccaggcccccacgtccgagatccagctgaccgactacggcgccctcaccctggactgcagcccccgcaccgggctggacttcaacgagatggtcctcctgacgatgaaggagaagtcctggctggtgcacaagcagtggttcctcgacctgccgctgccctggaccagcggcgcctccaccagccaggagacctggaaccggcaggacctcctggtgacgttcaagaccgcccacgcgaagaagcaggaggtcgtggtgctgggcagccaggagggggccatgcacaccgccctcaccggcgccacggagatccagacctccgggaccaccacgatcttcgccggccacctgaagtgccgcctgaagatggacaagctcaccctgaagggggtcagctacgtgatgtgcaccggctccttcaagctggagaaggaggtggcggagacccagcacggcacggtcctggtccaggtgaagtacgaggggaccgacgccccctgcaagatccccttcagcacccaggacgagaagggcgtcacccagaacgggcggctcatcacggccaacccgatcgtgaccgacaaggagaagcccgtgaacatcgagaccgagccgcccttcggcgagtcctacatcgtcatcggcgccggggagaaggcgctgaagctgagctggttcaagaagggctccagcatcgggaagatgttcgaggccaccgcccgcggcgcccggcgcatggccatcctcggggacacggcgtgggacttcggctccatcggcggggtgttcaccagcgtgggcaagctggtccaccaggtgttcgggaccgcctacggcgtgctgttctccggggtcagctggaccatgaagatcggcatcggcatcctcctgacgtggctggggctcaactcccgcagcacctccctgagcatgacctgcatcgccgtgggcatggtgaccctgtacctcggggtcatggtgcaggccgacacgggctgcgtgatcaactggaaggggcgggagctgaagtgcggctccggcatcttcgtcaccaacgaggtgcacacctggaccgagcagtacaagttccaggccgacagcccgaagcgcctgtccgcggccatcgggaaggcctgggaggagggcgtgtgcgggatccggagcgccacccgcctcgagaacatcatgtggaagcagatcagcaacgagctgaaccacatcctgctcgagaacgacatgaagttcacggtcgtggtgggcgacgccaacgggatcctgacccagggcaagaagatgatccggccccagcccatggagcacaagtactcctggaagtcctggggcaaggcgaagatcatcggggccgacacccagaacaccacgttcatcatcgacggccccgacaccccggagtgccccgacgaccagcgcgcctggaacatctgggaggtcgaggactacgggttcggcatcttcaccaccaacatctggctgaagctccgggactcctacacgcagatgtgcgaccaccgcctgatgagcgccgcgatcaaggactccaaggccgtgcacgccgacatgggctactggatcgagagcgagaagaacgagacctggaagctggcccgggcctccttcatcgaggtgaagacctgcatctggccccgcagccacaccctctggtccaacggggtcctggagagcgagatgatcatccccaagatctacggcgggccgatctcccagcacaactaccggcccggctacttcacgcagaccgcggggccctggcacctgggcaagctcgagctggacttcaacctgtgcgagggcaccaccgtggtggtcgacgagcactgcgggaaccgcggcccgagcctccggacgaccaccgtgaccgggaagatcatccacgagtggtgctgccgctcctgcacgctgccgcccctgcggttccgcggcgaggacgggtgctggtacggcatggagatccggcccgtgaaggagaaggaggagaacctcgtccgcagcatggtgtccgccggcagcggggaggtggactccttcagcctgggcctgctctgcgtcagcatcatgatcgaggaggtgatgcggtcccgctggagccgcaagatgctgatgaccgggaccctggccgtgttcttcctcctgatcatgggccagctgacctggaacgacctcatccggctgtgcatcatggtcggggccaacgtgtccgaccgcatgggcatgggcacgacctacctggccctcatggcgaccttcaagatgcggccgatgttcgccgtggggctgctgttccgccggctcaccagccgcgaggtcctgctgctcacgatcggcctgtccctggtggccagcgccgagctccccaactccctggaggagctgggggacggcctcgccatgggcatcatgatgctgaagctgctcaccgacttccagagccaccagctgtggaccaccctgctctccctgacgttcatcaagaccaccctgagcctcgactacgcgtggaagaccatcgccatgatcctgtccatcgtcagcctgttccccctctgcctgtccacgaccagccagaagaccacctggctgcccgtgctcctggggtccttcggctgcaagccgctgaccatgttcctcatcacggagaacaagatctgggggcgcaagagctggcccctgaacgagggcatcatggccgtggggatcgtctccatcctgctcagctccctgctgaagaacgacgtgcccctcgccggccccctgatcgcgggcgggatgctgatcgcctgctacgtgatcagcggcagctccgccgacctcagcctggagcgcgccgccgaggtctcctgggaggaggaggcggagcacagcggggcctcccacaacatcctggtggaggtgcaggacgacggcaccatgaagatcaaggacgaggagcgggacgacaccctcaccatcctgctgaaggccacgctcctggccgtcagcggggtgtacccgatgtccatccccgccaccctgttcgtgtggtacttctggcagaagaagaagcagcgcagcggcgtcctctgggacacccccagcccgcccgaggtggagcgggcggtgctggacgacggcatctaccgcatcctgcagcgggggctgctcggccgcagccaggtcggggtgggcgtgttccaggacggggtcttccacaccatgtggcacgtgacgcggggcgccgtgctgatgtaccagggcaagcgcctggagccctcctgggccagcgtcaagaaggacctcatctcctacgggggcgggtggcggttccagggcagctggaacaccggggaggaggtccaggtgatcgccgtcgagcccggcaagaaccccaagaacgtgcagaccacccccggcacgttcaagacccccgagggggaggtgggcgccatcgcgctggacttcaagcccgggacctccggcagccccatcgtcaaccgcgagggcaagatcgtggggctgtacggcaacggggtggtcaccacgtccggcacctacgtgagcgccatcgcccaggccaaggcctcccaggaggggccgctccccgagatcgaggacgaggtgttcaagaagcggaacctgaccatcatggacctgcaccccggcagcggcaagacccgccggtacctcccggcgatcgtccgcgaggccatcaagcgcaagctgcggacgctgatcctcgcccccacccgcgtggtggccagcgagatggcggaggccctgaaggggatgcccatccggtaccagaccaccgccgtcaagtccgagcacacgggccgcgagatcgtggacctgatgtgccacgccaccttcaccatgcggctcctgagccccgtgcgcgtcccgaactacaacatgatcatcatggacgaggcccacttcaccgaccccgcgtccatcgccgcccgggggtacatcagcacgcgcgtgggcatgggggaggccgccgcgatcttcatgaccgccacgccgcccggctccgtggaggccttcccgcagagcaacgccgtcatccaggacgaggagcgggacatccccgagcgctcctggaacagcggctacgactggatcaccgacttccccgggaagacggtgtggttcgtgccctccatcaagagcggcaacgacatcgccaactgcctgcggaagaacgggaagcgcgtcatccagctctcccggaagaccatcgacaccgagtaccagaagaccaagaacaacgactgggactacgtggtgacgaccgacatcagcgagatgggcgcgaacttccgcgccgaccgggtcatcgacccgcgccggtgcctgaagcccgtgatcctgaaggacgggcccgagcgcgtgatcctcgccggccccatgccggtcaccgccgcgtccgccgcccagcggcgcggccgcatcgggcggaaccagaacaaggagggcgaccagtacatctacatggggcagcccctgaacaacgacgaggaccacgcccactggaccgaggccaagatgctgctcgacaacatcaacacgcccgagggcatcatccccgcgctgttcgagccggagcgcgagaagtccgccgccatcgacggggagtaccggctgcgcggcgaggcccggaagaccttcgtggagctcatgcgccggggcgacctgcccgtctggctgtcctacaaggtggccagcgaggggttccagtactccgaccgccggtggtgcttcgacggcgagcgcaacaaccaggtgctcgaggagaacatggacgtcgagatctggaccaaggagggggagcggaagaagctgcgcccccggtggctggacgcgcgcacctacagcgaccccctcgccctgcgggagttcaaggagttcgccgccggccgccggtccgtgagcggcgacctgatcctcgagatcgggaagctgccgcagcacctgaccctccgcgcccagaacgcgctggacaacctggtgatgctccacaacagcgagcagggcgggaaggcctaccggcacgccatggaggagctgcccgacacgatcgagaccctgatgctcctggccctgatcgcggtcctcaccggcggggtgaccctgttcttcctgtccggcaagggcctcgggaagacgagcatcggcctgctgtgcgtgatggcctccagcgtcctcctgtggatggcctccgtggagccccactggatcgccgccagcatcatcctggagttcttcctcatggtgctgctgatccccgagccggaccgccagcggacgccccaggacaaccagctcgcgtacgtcgtgatcgggtccctgttcatgatcctgaccgtggccgccaacgagatgggcctcctggagaccacgaagaaggacctggggatcggccacgtcgtggccgagaaccaccaccacgccaccaccctcgacatcgacctgcaccccgcgagcgcctggaccctgtacgccgtggccacgaccatcatcaccccgatgatgcgccacaccatcgagaacacgaccgccaacatctccctcaccgcgatcgccaaccaggccgccatcctgatgggcctggacaaggggtggcccatcagcaagatggacatcggcgtccccctcctggccctggggtgctactcccaggtgaaccccctcaccctgacggcggccgtgctgatgctcgtcgcccactacgccatcatcggcccggggctgcaggcgaaggccacccgcgaggcccagaagcggaccgccgccggcatcatgaagaaccccaccgtggacggcatcgtggcgatcgacctggaccccgtcgtgtacgacgccaagttcgagaagcagctcgggcagatcatgctgctgatcctctgcacgagccagatcctgctgatgcgcaccacctgggccctctgcgagtccatcaccctggccacgggccccctgaccaccctctgggaggggagcccgggcaagttctggaacaccacgatcgccgtgtccatggcgaacatcttccggggcagctacctggccggggccggcctggccttctccctcatgaagtccctcgggggcgggcgccggggcaccggcgcccagggggagaccctgggcgagaagtggaagcgccagctcaaccagctgtccaagagcgagttcaacacctacaagcggagcgggatcatggaggtcgaccgctccgaggcgaaggagggcctgaagcgcggggagacgaccaagcacgccgtgagccgcggcaccgccaagctccggtggttcgtggagcgcaacctggtcaagcccgagggcaaggtgatcgacctggggtgcggccgcgggggctggtcctactactgcgccgggctgaagaaggtgaccgaggtcaagggctacaccaagggcgggcccggccacgaggagcccatcccgatggcgacgtacgggtggaacatcgtgaagctccacagcggcaaggacgtgttcttcacgccgcccgagaagtgcgacaccctgctgtgcgacatcggggagtccagccccaacccgaccatcgaggagggccgcacgctccgggtcctgaagatggtggagccctggctgcgcggcaaccagttctgcatcaagatcctcaacccctacatgccctccgtggtcgagaccctggagcagatgcagcggaagcacgggggcatgctggtgcgcaacccgctcagccggaactccacccacgagatgtactgggtgagctgcgggaccggcaacatcgtctccgccgtgaacatgacgagccgcatgctgctgaaccgcttcaccatggcccaccggaagcccacctacgagcgcgacgtggacctcggcgccgggacccggcacgtcgccgtggagcccgagatcgcgaacctggacatcatcggccagcgcatcgagaacatcaagaacgagcacaagtccacgtggcactacgacgaggacaacccctacaagacctgggcctaccacgggagctacgaggtgaagccgtccggcagcgcctccagcatggtcaacggggtggtgcggctgctcaccaagccctgggacgtcatccccatggtgacccagatcgccatgacggacaccacccccttcggccagcagcgcgtcttcaaggagaaggtggacacccggacgccgcgccccaagcggggcaccgcccagatcatggaggtgaccgcgaagtggctgtgggggttcctgtcccgcaacaagaagccccggatctgcacccgcgaggagttcacgcggaaggtccgcagcaacgccgccatcggcgccgtgttcgtggacgagaaccagtggaacagcgccaaggaggcggtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaagggctcccgggccatctggtacatgtggctcggggcgcgcttcctggagttcgaggccctgggcttcatgaacgaggaccactggttcagccgggagaactccctcagcggggtcgagggcgaggggctgtacaagctgggctacatcctccgcgacatctccaagatcccgggcgggaacatgtacgccgacgacaccgccggctgggacacccgcatcacggaggacgacctgcagaacgaggccaagatcaccgacatcatggagcccgagcacgcgctgctcgccaccagcatcttcaagctgacctaccagaacaaggtggtgcgggtccagcgccccgccaagtccgggacggtgatggacgtgatcagccggcgcgaccagcggggctccggccaggtcgggacctacggcctgaacaccttcaccaacatggaggtgcagctcatccgccagatggagagcgaggggatcttctcccccagcgagctggagaactccaacctggccgagcgggtgctcgactggctggagaagcacggcgtcgagcgcctgaagcggatggccatcagcggggacgactgcgtggtgaagccgacggacgaccgcttcgcgaccgccctcaccgccctgaacgacatgggcaaggtccggaaggacatcccccagtgggagccctccaagggctggaacgactggcagcaggtccccttctgcagccaccacttccaccagctgatcatgaaggacgggcgcgagatcgtggtcccgtgccggaaccaggacgagctcgtgggccgcgcccgggtgtcccagggggccggctggagcctgcgcgagaccgcgtgcctgggcaagagctacgcccagatgtggcagctcatgtacttccaccggcgcgacctgcggctggccgccaacgccatctgctccgcggtccccgtgaactgggtgcccaccagccgcacgacctggtccatccacgcccaccaccagtggatgaccaccgaggacatgctcagcgtctggaaccgcgtgtggatcgaggagaacccctggatggaggacaagacgcacgtgtccagctgggaggacgtcccgtacctgggcaagcgggaggaccagtggtgcggctccctgatcgggctcaccgcccgcgccacctgggcgaccaacatccaggtggccatcaaccaggtgcggcgcctgatcggcaacgagaactacagcgactacacgacctccatgaagcggttcaagaacgagagcgaccccgagggggccctgtggtga

SEQ ID NO: 7947 - RNA, 9879 nt, synthetic construct
  misc_feature 1..9879: note = derived and/or modified CDS sequence (opt1) from DENV-1__JN903580__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccttctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgcaacacctccctgagcatgacctgcatcgccgtggggatggtgaccctgtacctcggcgtcatggtgcaggccgacacggggtgcgtgatcaactggaagggccgggagctgaagtgcgggtccggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatcagcaacgagctgaaccacatcctgctcgagaacgacatgaagttcacggtcgtggtgggggacgccaacggcatcctgacccaggggaagaagatgatccggccccagcccatggagcacaagtactcctggaagtcctggggcaaggcgaagatcatcggcgccgacacccagaacaccacgttcatcatcgacgggcccgacaccccggagtgccccgacgaccagcgcgcctggaacatctgggaggtcgaggactacggcttcgggatcttcaccaccaacatctggctgaagctccgggactcctacacgcagatgtgcgaccaccgcctgatgagcgccgcgatcaaggactccaaggccgtgcacgccgacatgggctactggatcgagagcgagaagaacgagacctggaagctggcccgggcctccttcatcgaggtgaagacctgcatctggccccgcagccacaccctctggtccaacggcgtcctggagagcgagatgatcatccccaagatctacgggggcccgatctcccagcacaactaccggcccgggtacttcacgcagaccgcgggcccctggcacctggggaagctcgagctggacttcaacctgtgcgagggcaccaccgtggtggtcgacgagcactgcggcaaccgcgggccgagcctccggacgaccaccgtgaccggcaagatcatccacgagtggtgctgccgctcctgcacgctgccgcccctgcggttccgcggggaggacggctgctggtacgggatggagatccggcccgtgaaggagaaggaggagaacctcgtccgcagcatggtgtccgccggcagcggcgaggtggactccttcagcctggggctgctctgcgtcagcatcatgatcgaggaggtgatgaagtcccggtggagccgcaagatgctgatgaccggcaccctggccgtgttcttcctcctgatcatggggcagctgacctggaacgacctcatccgcctgtgcatcatggtcggcgccaacgtgtccgaccggatggggatgggcacgacctacctggccctcatggcgaccttcaagatgcgcccgatgttcgccgtggggctgctgttccggcgcctcaccagccgggaggtcctgctgctcacgatcgggctgtccctggtggccagcgccgagctccccaactccctggaggagctgggcgacgggctcgccatgggcatcatgatgctgaagctgctcaccgacttccagagccaccagctgtggaccaccctgctctccctgacgttcatcaagaccaccctgagcctcgactacgcgtggaagaccatcgccatgatcctgtccatcgtcagcctgttccccctctgcctgtccacgaccagccagaagaccacctggctgcccgtgctcctgggctccttcgggtgcaagccgctgaccatgttcctcatcacggagaacaagatctggggccgcaagagctggcccctgaacgaggggatcatggccgtgggcatcgtctccatcctgctcagctccctgctgaagaacgacgtgcccctcgccgggcccctgatcgcgggcggcatgctgatcgcctgctacgtgatcagcgggagctccgccgacctcagcctggagcgggccgccgaggtctcctgggaggaggaggcggagcacagcggcgcctcccacaacatcctggtggaggtgcaggacgacgggaccatgaagatcaaggacgaggagcgcgacgacaccctcaccatcctgctgaaggccacgctcctggccatcagcggcgtctacccgatgtccatccccgccaccctgttcgtgtggtacttctggcagaagaagaagcagcggagcggggtgctctgggacacccccagcccgcccgaggtcgagcgcgcggtgctggacgacggcatctaccggatcctgcagcgcggcctgctcgggcggagccaggtgggcgtcggggtgttccaggacggcgtgttccgcaccatgtggcacgtcacgcgcggggccgtgctgatgtaccagggcaagcgcctggagccctcctgggccagcgtgaagaaggacctcatctcctacggcgggggctggcggttccaggggagctggaacaccggcgaggaggtccaggtgatcgccgtggagcccgggaagaaccccaagaacgtccagaccacccccggcacgttcaagacccccgagggcgaggtgggggccatcgcgctggacttcaagcccggcacctccgggagccccatcgtgaaccgcgagggcaagatcgtcggcctgtacgggaacggcgtggtgaccacgtccgggacctacgtcagcgccatcgcccaggccaaggcctcccaggagggcccgctccccgagatcgaggacgaggtgttcaagaagcggaacctgaccatcatggacctgcaccccgggagcggcaagacccgccggtacctcccggcgatcgtgcgcgaggccatcaagcgcaagctgcggacgctgatcctcgcccccacccgcgtcgtggccagcgagatggcggaggccctgaagggcatgcccatccggtaccagaccaccgccgtgaagtccgagcacacggggcgcgagatcgtcgacctgatgtgccacgccaccttcaccatgcggctcctgagccccgtgcgcgtgccgaactacaacatgatcatcatggacgaggcccacttcaccgaccccgcgtccatcgccgcccggggctacatcagcacgcgcgtcgggatgggcgaggccgccgcgatcttcatgaccgccacgccgcccgggtccgtggaggccttcccgcagagcaacgccgtgatccaggacgaggagcgggacatccccgagcgctcctggaacagcggctacgactggatcaccgacttccccggcaagacggtctggttcgtgccctccatcaagagcgggaacgacatcgccaactgcctgcggaagaacggcaagcgcgtgatccagctctcccggaagaccttcgacaccgagtaccagaagaccaagaacaacgactgggactacgtcgtgacgaccgacatcagcgagatgggggcgaacttccgcgccgaccgggtgatcgacccgcgccggtgcctgaagcccgtcatcctgaaggacggccccgagcgcgtgatcctcgccgggcccatgccggtgaccgccgcgtccgccgcccagcggcgcggccgcatcggccggaaccagaacaaggagggggaccagtacatctacatgggccagcccctgaacaacgacgaggaccacgcccactggaccgaggccaagatgctgctcgacaacatcaacacgcccgaggggatcatccccgcgctgttcgagccggagcgcgagaagtccgccgccatcgacggcgagtaccggctgcgcggggaggcccggaagaccttcgtcgagctcatgcgccggggcgacctgcccgtgtggctgtcctacaaggtcgccagcgagggcttccagtactccgaccgccggtggtgcttcgacggggagcgcaacaaccaggtgctcgaggagaacatggacgtggagatctggaccaaggagggcgagcggaagaagctgcgcccccggtggctggacgcgcgcacctacagcgaccccctcgccctgcgggagttcaaggagttcgccgccgggcgccggtccgtcagcggcgacctgatcctcgagatcggcaagctgccgcagcacctgaccctccgcgcccagaacgcgctggacaacctggtgatgctccacaacagcgagcagggcgggaaggcctaccggcacgccatggaggagctgcccgacacgatcgagaccctgatgctcctggccctgatcgcggtgctcaccgggggcgtcaccctgttcttcctgtccgggaagggcctcggcaagacgagcatcgggctgctgtgcgtgatggcctccagcgtgctcctgtggatggcctccgtcgagccccactggatcgccgccagcatcatcctggagttcttcctcatggtgctgctgatccccgagccggaccgccagcggacgccccaggacaaccagctcgcgtacgtggtcatcggcctgctgttcatgatcctcaccgtggccgccaacgagatggggctgctggagaccacgaagaaggacctcggcatcgggcacgtggtcgccgagaaccaccaccacgccaccatgctggacatcgacctgcaccccgcgtccgcctggaccctctacgccgtggccaccacgatcatcaccccgatgatgcgccacaccatcgagaacaccacggccaacatcagcctgaccgcgatcgccaaccaggccgccatcctgatgggcctcgacaagggctggcccatctccaagatggacatcggggtgcccctgctggccctcggctgctacagccaggtcaaccccctgaccctgaccgcggccgtgctcatgctggtggcccactacgccatcatcgggccgggcctgcaggcgaaggccacgcgcgaggcccagaagcggaccgccgccgggatcatgaagaaccccaccgtcgacggcatcgtggcgatcgacctcgaccccgtggtctacgacgccaagttcgagaagcagctgggccagatcatgctgctcatcctgtgcacctcccagatcctgctcatgcgcacgacctgggccctgtgcgagagcatcaccctggccaccgggcccctcacgaccctgtgggagggctccccggggaagttctggaacaccaccatcgccgtgagcatggcgaacatcttccggggctcctacctggccggcgccgggctcgccttcagcctgatgaagtccctgggcgggggccgccgggacacgggggcccagggcgagaccctcggcgagaagtggaagcgccagctgaaccagctgagcaagcccgagttcaacacctacaagcggtccgggatcatggaggtggaccgcagcgaggcgaaggagggcctcaagcgcggggagaccacgaagcacgccgtcagccgcggcaccgccaagctgcggtggttcgtggagcgcaacctggtgaagcccgaggggaaggtcatcgacctgggctgcggccgcggcgggtggtcctactactgcgccgggctcaagaaggtgaccgaggtgaaggggtacaccaagggcgggcccggccacgaggagccgatccccatggcgacctacgggtggaacatcgtcaagctgcacagcggcaaggacgtgttcttcacgccgcccgagaagtgcgacaccctgctctgcgacatcggggagtccagcccgaaccccaccatcgaggagggccgcaccctgcgggtgctgaagatggtcgagccctggctccgcgggaaccagttctgcatcaagatcctgaacccctacatgccgtccgtggtggagacgctggagcagatgcagcggaagcacggcggcatgctcgtccgcaaccccctgagccggaactccacccacgagatgtactgggtgagctgcgggaccggcaacatcgtgtccgccgtcaacatgaccagccgcatgctgctcaaccgcttcacgatggcccaccggaagcccacctacgagcgcgacgtggacctgggggccggcacccggcacgtggccgtcgagcccgagatcgcgaacctggacatcatcggccagcgcatggagaacatcaagaacgagcacaagtccacctggcactacgacgaggacaacccgtacaagacgtgggcctaccacgggagctacgaggtgaagccctccggcagcgcctccagcatggtgaacggggtcgtgcggctcctgaccaagccctgggacgtgatccccatggtcacccagatcgccatgaccgacacgaccccgttcggccagcagcgcgtgttcaaggagaaggtcgacacccggacgccccggcccaagcgggggacggcccagatcatggaggtgaccgcgaagtggctgtggggcttcctctcccgcaacaagaagccgcggatctgcacccgcgaggagttcacccggaaggtgcgcagcaacgccgccatcggcgccgtcttcgtggacgagaaccagtggaactccgccaaggaggcggtggaggacgagcggttctgggacctggtccaccgcgagcgggagctgcacaagcaggggaagtgcgccacgtgcgtgtacaacatgatgggcaagcgcgagaagaagctcggggagttcggcaaggccaaggggagccgggccatctggtacatgtggctgggcgcgcgcttcctggagttcgaggccctcggcttcatgaacgaggaccactggttcagccgggagaactccctgagcggggtggagggcgaggggctgtacaagctcggctacatcctgcgcgacatctccaagatccccgggggcaacatgtacgccgacgacaccgccggctgggacacccgcatcaccgaggacgacctgcagaacgaggccaagatcacggacatcatggagcccgagcacgcgctcctggccaccagcatcttcaagctgacctaccagaacaaggtcgtgcgggtgcagcgccccgccaagtccgggaccgtcatggacgtgatcagccggcgcgaccagcggggctccggccaggtgggcacgtacggcctcaacaccttcaccaacatggaggtccagctgatccgccagatggagagcgaggggatcttctccccgagcgagctggagaactccaacctcgccgagcgggtgctggactggctggagaagcacggcgtggagcgcctcaagcggatggccatcagcggggacgactgcgtcgtgaagcccaccgacgaccgcttcgcgacggccctgaccgccctgaacgacatgggcaaggtgcggaaggacatcccccagtgggagccctccaaggggtggaacgactggcagcaggtcccgttctgcagccaccacttccaccagctcatcatgaaggacggccgcgagatcgtggtgccctgccggaaccaggacgagctggtcggccgcgcccgggtgtcccagggggccggctggagcctgcgcgagaccgcgtgcctcgggaagtcctacgcccagatgtggcagctgatgtacttccaccggcgcgacctgcggctcgccgccaacgccatctgcagcgcggtgcccgtcaactgggtgcccaccagccgcaccacgtggtccatccacgcccaccaccagtggatgaccaccgaggacatgctgagcgtgtggaaccgcgtctggatcgaggagaacccgtggatggaggacaagacccacgtgtccagctgggaggacgtgccctacctgggcaagcgggaggaccagtggtgcgggtccctcatcggcctgacggcccgcgccacctgggcgaccaacatccaggtcgccatcaaccaggtgcggcgcctgatcggcaacgagaactacagcgactacatgacctccatgaagcggttcaagaacgagagcgaccccgagggggccctctggtga

SEQ ID NO: 7948 - RNA, 9879 nt, synthetic construct
  misc_feature 1..9879: note = derived and/or modified CDS sequence (opt1) from DENV-1__JN903581__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccttctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgcaacacctccctgagcatgacctgcatcgccgtggggatggtgaccctgtacctcggcgtcatggtgcaggccgacacggggtgcgtgatcaactggaagggccgggagctgaagtgcgggtccggcatcttcgtcaccaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatcagcaacgagctgaaccacatcctgctcgagaacgacatgaagttcacggtcgtggtgggggacgccaacggcatcctgacccaggggaagaagatgatccggccccagcccatggagcacaagtactcctggaagtcctggggcaaggcgaagatcatcggcgccgacacccagaacaccacgttcatcatcgacgggcccgacaccccggagtgccccgacgaccagcgcgcctggaacatctgggaggtcgaggactacggcttcgggatcttcaccaccaacatctggctgaagctccgggactcctacacgcagatgtgcgaccaccgcctgatgagcgccgtgatcaaggactccaaggcggtgcacgccgacatgggctactggatcgagagcgagaagaacgagacctggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacgcagaccgccggcccctggcacctggggaagctcgagctggacttcaacctgtgcgagggcaccaccgtggtcgtggacgagcactgcggcaaccgcgggccgagcctccggacgaccaccgtgaccggcaagatcatccacgagtggtgctgccgctcctgcacgctgccgcccctgcggttccgcggggaggacggctgctggtacgggatggagatccggcccgtcaaggaggaggaggagaacctcgtgcgcagcatggtgtccgcgggcagcggcgaggtcgactccttcagcctggggctgctctgcgtgagcatcatgatcgaggaggtgatgaagtcccggtggagccgcaagatgctgatgaccggcaccctggccgtcttcttcctcctgatcatggggcagctgacctggaacgacctcatccgcctgtgcatcatggtgggcgccaacgtgtccgaccggatggggatgggcacgacctacctggccctcatggccaccttcaagatgcgcccgatgttcgcggtcgggctgctgttccggcgcctcaccagccgggaggtgctgctgctcacgatcgggctgtccctggtcgccagcgccgagctccccaactccctggaggagctgggcgacgggctcgccatgggcatcatgatgctgaagctgctcgccgacttccagagccaccagctgtggaccaccctgctctccctgaccttcatcaagacgaccctgagcctcgactacgcgtggaagaccatcgccatgatcctgtccatcgtgagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtcggcatcgtgtccatcctgctcagctccctgctgaagaacgacgtgcccctcgccgggcccctgatcgcgggcggcatgctgatcgcctgctacgtcatcagcgggagctccgccgacctcagcctggagcgggccgccgaggtgtcctgggaggaggaggcggagcacagcggcgcctcccacaacatcctggtggaggtccaggacgacgggacgatgaagatcaaggacgaggagcgcgacgacaccctcaccatcctgctgaaggccaccctcctggccatcagcggcgtgtacccgatgtccatccccgccacgctgttcgtgtggtacttctggcagaagaagaagcagcggagcggggtcctctgggacacccccagcccgcccgaggtggagcgcgcggtgctggacgacggcatctaccggatcctgcagcgcggcctgctcgggcggagccaggtcggcgtgggggtgttccaggacggcgtcttccacaccatgtggcacgtgacccgcggggccgtgctgatgtaccagggcaagcggctggagccctcctgggccagcgtcaagaaggacctcatctcctacggcgggggctggcgcttccaggggagctggaacacgggcgaggaggtccaggtgatcgccgtcgagcccgggaagaaccccaagaacgtgcagaccacccccggcaccttcaagacgcccgagggcgaggtgggggccatcgcgctggacttcaagcccggcacctccgggagccccatcgtcaaccgggagggcaagatcgtgggcctgtacggggacggcgtggtcaccacctccgggacgtacgtgagcgccatcgcccaggccaaggcctcccaggagggcccgctccccgagatcgaggacgaggtgttcaagaagcgcaacctgaccatcatggacctgcaccccgggagcggcaagacccggcgctacctcccggcgatcgtccgggaggccatcaagcgcaagctgcgcaccctgatcctcgcccccacgcgggtggtggccagcgagatggcggaggccctgaagggcatgcccatccgctaccagaccaccgccgtcaagtccgagcacaccgggcgggagatcgtggacctgatgtgccacgccacgttcaccatgcgcctcctgagccccgtgcgggtcccgaactacaacatgatcatcatggacgaggcccacttcaccgaccccgcgtccatcgccgcccgcggctacatcagcacccgggtggggatgggcgaggccgccgcgatcttcatgacggccacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagacgttcgacaccgagtaccagaagaccaagaacaacgactgggactacgtggtgaccacggacatcagcgagatgggggcgaacttccgggccgaccgcgtcatcgacccgcggcgctgcctggagcccgtgatcctgaaggacggccccgagcgggtgatcctcgccgggcccatgccggtcaccgccgcgtccgccgcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgcgctgttcgagccggagcgggagaagtccgccgccatcgacggcgagtaccgcctgcgcggggaggcccgcaagacgttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcgcggacctacagcgaccccctcgccctgcgcgagttcaaggagttcgccgccgggcggcgctccgtgagcggcgacctgatcctcgagatcggcaagctgccgcagcacctgaccctccgggcccagaacgcgctggacaacctggtgatgctccacaacagcgagcagggcgggaaggcctaccgccacgccatggaggagctgcccgacaccatcgagacgctgatgctcctggccctgatcgcggtcctcaccgggggcgtgaccctgttcttcctgtccgggaagggcctcggcaagaccagcatcgggctgctgtgcgtgatggcctccagcgtcctcctgtggatggcctccgtggagccccactggatcgccgccagcatcatcctggagttcttcctcatggtgctgctgatccccgagccggaccggcagcgcacgccccaggacaaccagctcgcgtacgtcgtgatcggcctgctgttcatgatcctcaccgtggccgccaacgagatggggctgctggagaccaccaagcgggacctcggcatcgggcacgtcgtggccgagaaccaccaccacgccacgatgctggacatcgacctgcaccccgcgtccgcctggaccctctacgccgtggccaccaccatcatcacgccgatgatgcgccacaccatcgagaacaccaccgccaacatcagcctgacggcgatcgccaaccaggccgccatcctgatgggcctcgacaagggctggcccatctccaagatggacatcggggtccccctgctggccctcggctgctacagccaggtgaaccccctgaccctgaccgcggccgtgctcatgctggtcgcccactacgccatcatcgggccgggcctgcaggcgaaggccacccgcgaggcccagaagcggacggccgccgggatcatgaagaaccccaccgtggacggcatcgtggcgatcgacctcgaccccgtcgtgtacgacgccaagttcgagaagcagctgggccagatcatgctgctcatcctgtgcacctcccagatcctgctcatgcgcaccacgtgggccctgtgcgagagcatcaccctggccaccgggcccctcaccacgctgtgggagggctccccggggaagttctggaacaccaccatcgccgtgagcatggcgaacatcttccggggctcctacctggccggcgccgggctcgccttcagcctgatgaagtccctgggcgggggccgccgggggaccggcgcccagggcgagacgctcggggagaagtggaagcgccagctgaaccagctgagcaagtccgagttcaacacctacaagcggagcggcatcatggaggtcgaccgcagcgaggcgaaggaggggctcaagcggggcgagaccaccaagcacgccgtgtcccgcgggacggtgaagctgcggtggttcgtcgagcgcaacctggtgaagcccgagggcaaggtgatcgacctgggctgcgggcggggcgggtggagctactactgcgccggcctcaagaaggtcaccgaggtgaaggggtacaccaagggcggccccgggcacgaggagcccatcccgatggccacctacggctggaacatcgtgaagctgcactccgggaaggacgtcttcttcacgccgcccgagaagtgcgacacgctgctctgcgacatcggcgagagctcccccaacccgaccatcgaggaggggcgcaccctgcgggtgctgaagatggtggagccctggctccgcggcaaccagttctgcatcaagatcctgaacccctacatgcccagcgtcgtggagaccctggagcagatgcagcggaagcacggcgggatgctcgtgcgcaacccgctgtcccggaacagcacgcacgagatgtactgggtctcctgcggcaccgggaacatcgtgagcgcggtgaacatgacctcccgcatgctgctcaaccgcttcaccatggcccaccggaagcccacgtacgagcgcgacgtcgacctgggcgccggcacccggcacgtggccgtggagcccgagatcgccaacctggacatcatcgggcagcgcatcgagaacatcaagaacgagcacaagagcacctggcactacgacgaggacaacccctacaagacctgggcgtaccacggctcctacgaggtcaagccgagcgggtccgccagctccatggtgaacggcgtggtccggctcctgacgaagccctgggacgtgatccccatggtcacccagatcgccatgaccgacaccacgcccttcgggcagcagcgcgtgttcaaggagaaggtggacacccggaccccgcgccccaagcggggcaccgcccagatcatggaggtcacggccaagtggctgtggggcttcctcagccgcaacaagaagccccggatctgcacccgcgaggagttcacccggaaggtgcgctccaacgcggccatcggggccgtgttcgtcgacgagaaccagtggaacagcgccaaggaggccgtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgtacaagctcgggtacatcctgcgcgacatcagcaagatcccgggcggcaacatgtacgccgacgacacggccgggtgggacacccgcatcaccgaggacgacctgcagaacgaggccaagatcaccgacatcatggagcccgagcacgccctcctggcgacgtccatcttcaagctgacctaccagaacaaggtggtccgggtgcagcgccccgccaagagcggcaccgtgatggacgtcatctcccggcgcgaccagcgggggagcggccaggtgggcacctacgggctcaacacgttcaccaacatggaggtgcagctgatccgccagatggagtccgagggcatcttcagcccctccgagctggagaacagcaacctcgccgagcgggtcctggactggctggagaagcacggggtggagcgcctcaagcggatggccatctccggcgacgactgcgtggtcaagccgaccgacgaccgcttcgccaccgcgctgacggccctgaacgacatggggaaggtgcggaaggacatcccccagtgggagcccagcaagggctggaacgactggcagcaggtccccttctgctcccaccacttccaccagctcatcatgaaggacggccgcgagatcgtcgtgccgtgccggaaccaggacgagctggtggggcgcgcccgggtcagccagggcgccgggtggtccctgcgcgagaccgcctgcctcggcaagagctacgcgcagatgtggcagctgatgtacttccaccggcgcgacctgcggctcgccgccaacgccatctgcagcgccgtgcccgtgaactgggtccccacctcccgcaccacctggagcatccacgcgcaccaccagtggatgacgaccgaggacatgctgtccgtgtggaaccgcgtgtggatcgaggagaacccctggatggaggacaagacccacgtcagctcctgggaggacgtgccgtacctggggaagcgggaggaccagtggtgcggcagcctcatcggcctgaccgcccgcgccacgtgggccaccaacatccaggtggcgatcaaccaggtccggcgcctgatcgggaacgagaactactccgactacatgaccagcatgaagcggttcaagaacgagtccgaccccgagggcgccctctggtga

SEQ ID NO: 7949 - RNA, 9879 nt, synthetic construct
  misc_feature 1..9879: note = derived and/or modified CDS sequence (opt1) from DENV-1__KX380796__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggcggcagatgcagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagaccgtccagtacgagaacctgaagtactccgtgatcgtgaccgtccacacgggcgaccagcaccaggtggggaacgagaccaccgagcacggcaccatcgcgaccatcacgccccaggcccccaccagcgagatccagctgaccgactacggggccctcaccctggactgcagcccccggacgggcctggacttcaacgagatggtcctcctgaccatgaaggagaagtcctggctggtgcacaagcagtggttcctcgacctgccgctgccctggacctccggggccagcaccagccaggagacgtggaaccggcaggacctcctggtgaccttcaagaccgcccacgcgaagaagcaggaggtcgtggtgctgggctcccaggagggcgccatgcacaccgccctcacgggggccaccgagatccagaccagcggcaccacgaccatcttcgccgggcacctgaagtgccgcctgaagatggacaagctcaccctgaagggcgtctcctacgtgatgtgcaccgggagcttcaagctggagaaggaggtggcggagacgcagcacggcaccgtcctggtccaggtgaagtacgagggcaccgacgccccctgcaagatccccttctccacccaggacgagaagggggtcacgcagaacggccggctcatcaccgccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccacggcccgcggggcccggcgcatggccatcctcggcgacaccgcgtgggacttcgggagcatcggcggcgtgttcacctccgtggggaagctggtccaccaggtgttcggcaccgcctacggggtgctgttcaacggcgtcagctggacgatgaagatcgggatcggcatcctcctgacctggctgggcctcaactcccgcagcacctccctgagcatgacctgcatcgccgtggggatggtgacgctgtacctcggcgtcatggtgcaggccgactccgggtgcgtgatcaactggaagggccgggagctgaagtgcgggagcggcatcttcgtcaccaacgaggtgcacacctggaccgagcagtacaagttccaggccgactccccgaagcgcctgagcgcggccatcggcaaggcctgggaggagggggtgtgcggcatccggagcgccacccgcctcgagaacatcatgtggaagcagatctccaacgagctgaaccacatcctgctcgagaacgacatgaagttcacggtcgtggtgggggacgccaacggcatcctgacccaggggaagaagatgatccggccccagcccatggagcacaagtacagctggaagtcctggggcaaggcgaagatcatcggcgccgacacccagaacaccacgttcatcatcgacgggcccgacaccccggagtgccccgacgaccagcgcgcctggaacatctgggaggtcgaggactacggcttcggggtgttcaccaccaacatctggctgaagctccgggacagctacacgcagatgtgcgaccaccgcctgatgtccgccgcgatcaaggacagcaaggccgtgcacgccgacatgggctactggatcgagtccgagaagaacgagacctggaagctggcccgggccagcttcatcgaggtcaagacctgcatctggccccgctcccacaccctctggagcaacggcgtgctggagtccgagatgatcatccccaagatctacgggggcccgatcagccagcacaactaccggcccgggtacttcacgcagaccgcgggcccctggcacctggggaagctcgagctggacttcgacctgtgcgagggcaccaccgtggtcgtggacgagcactgcggcaaccgcgggccgtccctccggacgaccaccgtgaccggcaagatcatccacgagtggtgctgccgcagctgcacgctgccgcccctgcggttccgcggggaggacggctgctggtacgggatggagatccggcccgtcaaggagaaggaggagaacctcgtgcgctccatggtgagcgccggctccggcgaggtcgacagcttcagcctggggctgctctgcgtgtccatcatgatcgaggaggtgatgcggagccgctggtcccgcaagatgctgatgaccggcaccctggccgtcttcttcctcctgatcatggggcagctgacctggaacgacctcatccggctgtgcatcatggtgggcgccaacgtgagcgaccgcatggggatgggcacgacctacctggccctcatggcgaccttcaagatgcggccgatgttcgccgtcgggctgctgttccgccggctcacctcccgcgaggtgctgctgctcacgatcgggctgagcctggtcgcctccgtggagctccccaacagcctggaggagctgggcgacgggctcgccatgggcatcatgatgctgaagctgctcaccgacttccagccccaccagctgtggaccaccctgctctccctgacgttcatcaagaccaccctgagcctcgactacgcctggaagaccatggcgatggtgctgtccatcgtcagcctgttccccctctgcctgtccacgaccagccagaagaccacctggctgccggtgctcctgggctccttcgggtgcaagcccctgaccatgttcctcatcacggagaacaagatctggggccgcaagagctggcccctgaacgaggggatcatggccgtgggcatcgtctccatcctgctcagctccctgctgaagaacgacgtgcccctcgccgggccgctgatcgccggcggcatgctgatcgcgtgctacgtgatcagcgggagctccgccgacctcagcctggagcgcgccgccgaggtctcctgggaggaggaggccgagcacagcggcgcgtcccacaacatcctggtggaggtgcaggacgacgggaccatgaagatcaaggacgaggagcgggacgacaccctcaccatcctgctgaaggccacgctcctggccgtcagcggcgtgtaccccatgtccatccccgccaccctgttcgtgtggtacttctggcagaagaagaagcagcgcagcggggtcctctgggacaccccctccccgcccgaggtggagcgggccgtgctggacgacggcatctaccgcatcctgcagcggggcctgctcgggcgcagccaggtcggcgtgggggtgttccaggacggcgtcttccacaccatgtggcacgtgacgcgcggggcggtgctgatgtaccagggcaagcgcctggagccctcctgggccagcgtcaagaaggacctcatctcctacggcgggggctggcggttccaggggagctggaacaccggcgaggaggtccaggtgatcgccgtcgagcccgggaagaacccgaagaacgtgcagaccacccccggcacgttcaagacccccgagggcgaggtgggggccatcgccctggacttcaagcccggcacctccgggagcccgatcgtcaaccgcgagggcaagatcgtgggcctgtacgggaacggcgtggtcaccacgtccgggacctacgtgagcgcgatcgcccaggccaaggcctcccaggagggccccctccccgagatcgaggacgaggtgttcaagaagcggaacctgaccatcatggacctgcacccggggagcggcaagacccgccggtacctccccgccatcgtccgcgaggcgatcaagcgcaagctgcggacgctgatcctcgcccccacccgcgtggtggccagcgagatggccgaggcgctgaagggcatgcccatccggtaccagaccaccgccgtcaagtccgagcacacggggaaggagatcgtggacctgatgtgccacgccaccttcaccatgcgcctcctgagcccggtgcgggtccccaactacaacatgatcatcatggacgaggcccacttcaccgaccccgcctccatcgcggcccgcggctacatcagcacgcgggtggggatgggcgaggccgccgccatcttcatgaccgcgacgccgcccgggtccgtggaggccttcccccagagcaacgccgtcatccaggacgaggagcgcgacatccccgagcggtcctggaacagcggctacgactggatcaccgacttccccggcaagacggtgtggttcgtgccctccatcaagagcgggaacgacatcgccaactgcctgcgcaagaacggcaagcgggtcatccagctctcccgcaagaccttcgacaccgagtaccagaagaccaagaacaacgactgggactacgtggtgacgaccgacatcagcgagatgggggccaacttccgggcggaccgcgtcatcgacccccggcgctgcctgaagcccgtgatcctgaaggacggccccgagcgggtcatcctcgccgggccgatgcccgtgaccgccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacgcccgaggggatcatcccggccctgttcgagcccgagcgggagaagtccgcggccatcgacggcgagtaccgcctgcgcggggaggcccgcaagaccttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcccggacctacagcgacccgctcgcgctgcgcgagttcaaggagttcgccgccgggcggcgctccgtgagcggcgacctgatcctcgagatcggcaagctgccccagcacctgaccctccgggcccagaacgccctggacaacctggtgatgctccacaacagcgagcagggcgggaaggcgtaccgccacgccatggaggagctgcccgacacgatcgagaccctgatgctcctggccctgatcgccgtcctcaccgggggcgtgaccctgttcttcctgtccgggaagggcctcggcaagacgagcatcgggctgctgtgcgtgatggcgtccagcgtcctcctgtggatggcctccgtggagccccactggatcgccgccagcatcatcctggagttcttcctcatggtgctgctgatcccggagcccgaccggcagcgcacgccccaggacaaccagctcgcctacgtcgtgatcggcctgctgttcatgatcctcaccgtggcggccaacgagatggggctgctggagaccacgaagaaggacctcggcatcgggcacgtcgtggccgagaaccaccaccacgccaccatgctggacatcgacctgcacccggcctccgcgtggaccctctacgccgtggccaccacgatcatcacccccatgatgcggcacaccatcgagaacaccacggccaacatcagcctgaccgccatcgcgaaccaggccgccatcctgatgggcctcgacaagggctggcccatctccaagatggacatcggggtccccctgctggccctcggctgctacagccaggtgaacccgctgaccctgaccgccgcggtgctcatgctggtcgcccactacgccatcatcgggcccggcctgcaggccaaggcgacgcgcgaggcccagaagcgcaccgccgccgggatcatgaagaaccccaccgtggacggcatcgtggccatcgacctcgaccccgtcgtgtacgacgcgaagttcgagaagcagctgggccagatcatgctgctcatcctgtgcacctcccagatcctgctcatgcggacgacctgggccctgtgcgagagcatcaccctggccaccgggccgctcacgaccctgtgggagggctcccccgggcgcttctggaacaccaccatcgccgtgagcatggccaacatcttccggggctcctacctggcgggcgccgggctcgccttcagcctgatgaagtccctgggcgggggccgccgggggacgggcgcccagggcgagaccctcggggagaagtggaagcgccagctgaaccagctgagcaagtccgagttcaacacctacaagcggagcggcatcatggaggtcgaccgcagcgaggccaaggaggggctcaagcggggcgagaccacgaagcacgcggtgtcccgcgggaccgccaagctgcggtggttcgtggagcgcaacctggtcaagcccgagggcaaggtgatcgacctgggctgcgggcggggcgggtggagctactactgcgccggcctcaagaaggtgaccgaggtcaaggggtacaccaagggcggccccgggcacgaggagccgatccccatggccacctacggctggaacatcgtgaagctgcactccgggcgcgacgtgttcttcacgccgcccgagaagtgcgacaccctgctctgcgacatcggcgagagctccccgaaccccaccatcgaggaggggcggaccctgcgcgtcctgaagatggtggagccctggctccggggcaaccagttctgcatcaagatcctgaacccctacatgccgagcgtggtcgagacgctggagcagatgcagcgcaagcacggcgggatgctcgtgcggaaccccctgtcccgcaacagcacccacgagatgtactgggtgtcctgcggcaccgggaacatcgtcagcgcggtgaacatgacctcccgcatgctgctcaaccggttcacgatggcccaccgcaagcccacctacgagcgggacgtggacctgggcgccggcacccgccacgtcgccgtggagcccgagatcgccaacctggacatcatcgggcagcggatcgagaacatcaagaacgagcacaagagcacctggcactacgacgaggacaacccgtacaagacgtgggcgtaccacggctcctacgaggtgaagcccagcgggtccgccagctccatggtcaacggcgtggtccgcctcctgaccaagccctgggacgtgatccccatggtgacccagatcgccatgaccgacacgaccccgttcgggcagcagcgggtcttcaaggagaaggtggacacccgcacgccccggcccaagcgcggcacggcccagatcatggaggtgaccgccaagtggctgtggggcttcctcagccggaacaagaagccgcgcatctgcacccgggaggagttcacccgcaaggtccggtccaacgcggccatcggggccgtgttcgtggacgagaaccagtggaacagcgccaaggaggccgtcgaggacgagcgcttctgggacctggtgcaccgggagcgcgagctgcacaagcagggcaagtgcgcgacgtgcgtgtacaacatgatggggaagcgggagaagaagctcggcgagttcgggaaggccaagggcagccgcgccatctggtacatgtggctgggcgcccggttcctggagttcgaggcgctcgggttcatgaacgaggaccactggttctcccgcgagaacagcctgtccggcgtcgagggggagggcctgcacaagctcgggtacatcctgcgcgacatcagcaagatccccggcggcaacatgtacgccgacgacaccgccgggtgggacacccggatcaccgaggacgacctgcagaacgaggccaagatcacggacatcatggagcccgagcacgccctcctggcgacctccatcttcaagctgacctaccagaacaaggtggtgcgcgtccagcggcccgccaagagcggcaccgtgatggacgtgatctcccgccgggaccagcgcgggagcggccaggtcggcacgtacgggctcaacaccttcaccaacatggaggtgcagctgatccggcagatggagtccgagggcatcttcagcccgtccgagctggagaacagcaacctcgccgagcgcgtgctggactggctggagaagcacggggtcgagcggctcaagcgcatggccatctccggcgacgactgcgtggtgaagcccaccgacgaccggttcgccacggcgctgaccgccctgaacgacatggggaaggtccgcaaggacatcccccagtgggagcccagcaagggctggaacgactggcagcaggtcccgttctgctcccaccacttccaccagctcatcatgaaggacggccgggagatcgtggtcccctgccgcaaccaggacgagctggtggggcgggcccgcgtgagccagggcgccgggtggtccctgcgggagaccgcctgcctcggcaagagctacgcgcagatgtggcagctgatgtacttccaccgccgggacctgcgcctcgccgccaacgccatctgcagcgccgtccccgtgaactgggtgcccacctcccgcaccacgtggagcatccacgcgcaccaccagtggatgaccaccgaggacatgctgtccgtctggaaccgggtgtggatcgaggagaacccgtggatggaggacaagacccacgtgagctcctgggaggacgtcccctacctggggaagcgcgaggaccagtggtgcggcagcctcatcggcctgacggcccgggccacctgggccaccaacatccaggtggcgatcaaccaggtgcgccggctgatcgggaacgagaactacctcgactacatgacctccatgaagcgcttcaagaacgagagcgaccccgagggcgccctgtggtga

SEQ ID NO: 7950 - RNA, 9879 nt, synthetic construct
  misc_feature 1..9879: note = derived and/or modified CDS sequence (opt1) from DENV-1__KX380799__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgacgggcaccctggccgtcttcttcctcctgatcatggggcagctgacctggaacgacctcatccggctgtgcatcatggtgggcgccaacgtgtccgaccgcatggggatgggcaccacgtacctggccctcatggcgaccttcaagatgcggccgatgttcgccgtcgggctgctgttccgccggctcaccagccgcgaggtgctgctgctcaccatcgggctgtccctggtcgccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctgggctccttcgggtgcaagccgctgaccatgttcctcatcaccgagaacaagatctggggccgcaagagctggcccctgaacgaggggatcatggccgtgggcatcgtctccatcctgctcagcagcctgctgaagaacgacgtgcccctcgccgggcccctgatcgccggcggcatgctgatcgcgtgctacgtgatctccgggagctccgccgacctcagcctggagcgcgccgccgaggtctcctgggaggaggaggccgagcacagcggcgcgtcccacaacatcctggtggaggtgcaggacgacgggacgatgaagatcaaggacgaggagcgggacgacaccctcaccatcctgctgaaggccaccctcctggccgtcagcggcgtgtacccgatgtccatccccgccacgctgttcgtgtggtacttctggcagaagaagaagcagcgcagcggggtcctctgggacacccccagcccgcccgaggtggagcgggccgtgctggacgacggcatctaccgcatcctgcagcggggcctgctcgggcgcagccaggtcggcgtgggggtgttccaggacggcgtcttccacaccatgtggcacgtgacccgcggggcggtgctgatgtaccagggcaagcgcctggagccctcctgggccagcgtcaagaaggacctcatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcacctccgggagccccatcgtcaaccgcgagggcaagatcgtgggcctgtacgggaacggcgtggtcaccacctccgggacgtacgtgagcgcgatcgcccaggccaaggccagccaggagggcccgctccccgagatcgaggacgaggtgttcaagaagcggaacctgaccatcatggacctgcaccccgggtccggcaagacccgccggtacctcccggccatcgtccgcgaggcgatcaagcgcaagctgcggaccctgatcctcgcccccacgcgcgtggtggccagcgagatggccgaggcgctgaagggcatgcccatccggtaccagaccaccgccgtcaagtccgagcacaccgggaaggagatcgtggacctgatgtgccacgccacgttcaccatgcgcctcctgagccccgtgcgggtcccgaactacaacatgatcatcatggacgaggcccacttcaccgaccccgcctccatcgcggcccgcggctacatcagcacccgggtggggatgggcgaggccgccgccatcttcatgacggcgacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagacgttcgacaccgagtaccagaagaccaagaacaacgactgggactacgtggtgaccacggacatcagcgagatgggggccaacttccgggcggaccgcgtcatcgacccgcggcgctgcctgaagcccgtgatcctgaaggacggccccgagcgggtcatcctcgccgggcccatgccggtgaccgccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtggagctcatgcggcgcggcgacctgcccgtctggctgtcctacaaggtggccagcgagggcttccagtactccgaccggcgctggtgcttcgacggggagcggaacaaccaggtgctcgaggagaacatggacgtcgagatctggaccaaggagggcgagcgcaagaagctgcggccccgctggctggacgcccggacctacagcgaccccctcgcgctgcgcgagttcaaggagttcgccgccgggcggcgcagcgtgtccggcgacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagacgctgatgctcctggccctgatcgccgtcctcaccgggggcgtgaccctgttcttcctgtccgggaagggcctcggcaagaccagcatcgggctgctgtgcgtgatggcgtccagcgtcctcctgtggatggcctccgtggagccccactggatcgccgccagcatcatcctggagttcttcctcatggtgctgctgatccccgagccggaccggcagcgcacgccccaggacaaccagctcgcctacgtcgtgatcggcctgctgttcatgatcctcaccgtggcggccaacgagatggggctgctggagaccaccaagaaggacctcggcatcgggcacgtcgtggccgagaaccaccaccacgccacgatgctggacatcgacctgcaccccgcctccgcgtggaccctctacgccgtggccaccaccatcatcacgccgatgatgcggcacaccatcgagaacaccaccgccaacatcagcctgacggccatcgcgaaccaggccgccatcctgatgggcctcgacaagggctggcccatctccaagatggacatcggggtccccctgctggccctcggctgctacagccaggtgaaccccctgaccctgaccgccgcggtgctcatgctggtcgcccactacgccatcatcgggccgggcctgcaggccaaggcgacccgcgaggcccagaagcgcacggccgccgggatcatgaagaaccccaccgtggacggcatcgtggccatcgacctcgaccccgtcgtgtacgacgcgaagttcgagaagcagctgggccagatcatgctgctcatcctgtgcacctcccagatcctgctcatgcggaccacgtgggccctgtgcgagagcatcaccctggccaccgggcccctcaccacgctgtgggagggctccccggggcgcttctggaacaccaccatcgccgtgagcatggccaacatcttccggggctcctacctggcgggcgccgggctcgccttcagcctgatgaagtccctgggcgggggccgccgggggaccggcgcccagggcgagacgctcggggagaagtggaagcgccagctgaaccagctgagcaagagcgagttcaacacctacaagcggtccggcatcatggaggtcgaccgcagcgaggccaaggaggggctcaagcggggcgagaccaccaagcacgcggtgtcccgcgggacggccaagctgcggtggttcgtggagcgcaacctggtcaagcccgagggcaaggtgatcgacctgggctgcgggcggggcgggtggagctactactgcgccggcctcaagaaggtgaccgaggtcaaggggtacaccaagggcggccccgggcacgaggagcccatcccgatggccacctacggctggaacatcgtgaagctgcactccgggcgcgacgtgttcttcacgccgcccgagaagtgcgacacgctgctctgcgacatcggcgagagctcccccaacccgaccatcgaggaggggcggaccctgcgcgtcctgaagatggtggagccctggctccggggcaaccagttctgcatcaagatcctgaacccctacatgcccagcgtggtcgagaccctggagcagatgcagcgcaagcacggcgggatgctcgtgcggaacccgctgtcccgcaacagcacgcacgagatgtactgggtgtcctgcggcaccgggaacatcgtcagcgcggtgaacatgacctcccgcatgctgctcaaccggttcaccatggcccaccgcaagcccacgtacgagcgggacgtggacctgggcgccggcacccgccacgtcgccgtggagcccgagatcgccaacctggacatcatcgggcagcggatcgagaacatcaagaacgagcacaagagcacctggcactacgacgaggacaacccctacaagacctgggcgtaccacggctcctacgaggtgaagccgagcgggtccgccagctccatggtcaacggcgtggtccgcctcctgacgaagccctgggacgtgatccccatggtgacccagatcgccatgaccgacaccacgcccttcgggcagcagcgggtcttcaaggagaaggtggacacccgcaccccgcggcccaagcgcggcaccgcccagatcatggaggtgacggccaagtggctgtggggcttcctcagccggaacaagaagccccgcatctgcacccgggaggagttcacccgcaaggtccggagcaacgcggccatcggggccgtgttcgtggacgagaaccagtggaactccgccaaggaggccgtcgaggacgagcgcttctgggacctggtgcaccgggagcgcgagctgcacaagcagggcaagtgcgcgacctgcgtgtacaacatgatggggaagcgggagaagaagctcggcgagttcgggaaggccaagggcagccgcgccatctggtacatgtggctgggcgcccggttcctggagttcgaggcgctcgggttcatgaacgaggaccactggttctcccgcgagaacagcctgtccggcgtcgagggggagggcctgcacaagctcgggtacatcctgcgcgacatcagcaagatcccgggcggcaacatgtacgccgacgacacggccgggtgggacacccggatcaccgaggacgacctgcagaacgaggccaagatcaccgacatcatggagcccgagcacgccctcctggcgacgtccatcttcaagctgacctaccagaacaaggtggtgcgcgtccagcggcccgccaagagcggcaccgtgatggacgtgatctcccgccgggaccagcgcgggagcggccaggtcggcacctacgggctcaacacgttcaccaacatggaggtgcagctgatccggcagatggagtccgagggcatcttcagcccctccgagctggagaacagcaacctcgccgagcgcgtgctggactggctggagaagcacggggtcgagcggctcaagcgcatggccatctccggcgacgactgcgtggtgaagccgaccgacgaccggttcgccaccgcgctgacggccctgaacgacatggggaaggtccgcaaggacatcccccagtgggagcccagcaagggctggaacgactggcagcaggtccccttctgctcccaccacttccaccagctcatcatgaaggacggccgggagatcgtggtcccgtgccgcaaccaggacgagctggtggggcgggcccgcgtgagccagggcgccgggtggagcctgcgggagaccgcctgcctcggcaagtcctacgcgcagatgtggcagctgatgtacttccaccgccgggacctgcgcctcgccgccaacgccatctgcagcgccgtccccgtgaactgggtgcccacctcccgcaccacctggagcatccacgcgcaccaccagtggatgacgaccgaggacatgctgtccgtctggaaccgggtgtggatcgaggagaacccctggatggaggacaagacccacgtgagctcctgggaggacgtcccgtacctggggaagcgcgaggaccagtggtgcggcagcctcatcggcctgaccgcccgggccacgtgggccaccaacatccaggtggcgatcaaccaggtgcgccggctgatcgggaacgagaactacctcgactacatgacctccatgaagcgcttcaagaacgagagcgaccccgagggcgccctgtggtga

SEQ ID NO: 7951 - RNA, 9879 nt, synthetic construct
  misc_feature 1..9879: note = derived and/or modified CDS sequence (opt1) from DENV-1__KX380800__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctctgcgtgagcatcatgatcgaggaggtgatgcggtcccgctggagccgcaagatgctgatgacgggcaccctggccatcttcttcctcctgatcatggggcagctgacctggaacgacctcatccggctgtgcatcatggtcggcgccaacgtgtccgaccgcatggggatgggcaccacgtacctggccctcatggcgaccttcaagatgcggccgatgttcgccgtggggctgctgttccgccggctcaccagccgcgaggtcctgctgctcaccatcgggctgtccctggtggccagcgtcgagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtgagcctgttccccctctgcctgtccaccacgagccagaagaccacctggctgcccgtcctcctgggctccttcgggtgcaagccgctgaccatgttcctcatcaccgagaacaagatctggggccgcaagagctggcccctgaacgaggggatcatggccgtgggcatcgtgtccatcctgctcagcagcctgctgaagaacgacgtccccctcgccgggcccctgatcgccggcggcatgctgatcgcgtgctacgtgatctccgggagctccgccgacctcagcctggagcgcgccgccgaggtgtcctgggaggaggaggccgagcacagcggcgcgtcccacaacatcctggtcgaggtgcaggacgacgggacgatgaagatcaaggacgaggagcgggacgacaccctcaccatcctgctgaaggccaccctcctggccgtgagcggcgtctacccgatgtccatccccgccacgctgttcgtgtggtacttctggcagaagaagaagcagcgcagcggggtgctctgggacacccccagcccgcccgaggtcgagcgggccgtgctggacgacggcatctaccgcatcctgcagcggggcctgctcgggcgcagccaggtgggcgtcggggtgttccaggacggcgtgttccacaccatgtggcacgtcacccgcggggcggtgctgatgtaccagggcaagcgcctggagccctcctgggccagcgtgaagaaggacctcatctcctacggcgggggctggcggttccaggggagctggaacacgggcgaggaggtccaggtgatcgccgtggagcccgggaagaaccccaagaacgtccagaccacccccggcaccttcaagacgcccgagggcgaggtgggggccatcgccctggacttcaagcccggcacctccgggagccccatcgtgaaccgcgagggcaagatcgtcggcctgtacgggaacggcgtggtgaccacctccgggacgtacgtcagcgcgatcgcccaggccaaggccagccaggagggcccgctccccgagatcgaggacgaggtgttcaagaagcggaacctgaccatcatggacctgcaccccgggtccggcaagacccgccggtacctcccggccatcgtgcgcgaggcgatcaagcgcaagctgcggaccctgatcctcgcccccacgcgcgtcgtggccagcgagatggccgaggcgctgaagggcatgcccatccggtaccagaccaccgccgtgaagtccgagcacaccgggaaggagatcgtcgacctgatgtgccacgccacgttcaccatgcgcctcctgagccccgtgcgggtgccgaactacaacatgatcatcatggacgaggcccacttcaccgaccccgcctccatcgcggcccgcggctacatcagcacccgggtcgggatgggcgaggccgccgccatcttcatgacggcgacgccgcccgggtccgtggaggccttcccgcagagcaacgccgtgatccaggacgaggagcgcgacatccccgagcggtcctggaacagcggctacgactggatcaccgacttccccggcaagaccgtctggttcgtgccctccatcaagagcgggaacgacatcgccaactgcctgcgcaagaacggcaagcgggtgatccagctctcccgcaagacgttcgacaccgagtaccagaagaccaagaacaacgactgggactacgtcgtgaccacggacatcagcgagatgggggccaacttccgggcggaccgcgtgatcgacccgcggcgctgcctgaagcccgtcatcctgaaggacggccccgagcgggtgatcctcgccgggcccatgccggtcaccgccgcctccgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtggagctcatgcggcgcggcgacctgcccgtgtggctgtcctacaaggtcgccagcgagggcttccagtactccgaccggcgctggtgcttcgacggggagcggaacaaccaggtgctcgaggagaacatggacgtggagatctggaccaaggagggcgagcgcaagaagctgcggccccgctggctggacgcccggacctacagcgaccccctcgcgctgcgcgagttcaaggagttcgccgccgggcggcgcagcgtctccggcgacctgatcctcgagatcggcaagctgccgcagcacctgaccctccgggcccagaacgccctggacaacctggtgatgctccacaacagcgagcagggcgggaaggcgtaccgccacgccatggaggagctgcccgacaccatcgagacgctgatgctcctggccctgatcgccgtgctcaccgggggcgtcaccctgttcttcctgtccgggaagggcctcggcaagaccagcatcgggctgctgtgcgtgatggcgtccagcgtgctcctgtggatggcctccgtcgagccccactggatcgccgccagcatcatcctggagttcttcctcatggtgctgctgatccccgagccggaccggcagcgcacgccccaggacaaccagctcgcctacgtggtcatcggcctgctgttcatgatcctcaccgtggcggccaacgagatggggctgctggagaccaccaagaaggacctcggcatcgggcacgtggtcgccgagaaccaccaccacgccacgatgctggacatcgacctgcaccccgcctccgcgtggaccctctacgccgtggccaccaccatcatcacgccgatgatgcggcacaccatcgagaacaccaccgccaacatcagcctgacggccatcgcgaaccaggccgccatcctgatgggcctcgacaagggctggcccatctccaagatggacatcggggtgcccctgctggccctcggctgctacagccaggtcaaccccctgaccctgaccgccgcggtgctcatgctggtggcccactacgccatcatcgggccgggcctgcaggccaaggcgacccgcgaggcccagaagcgcacggccgccgggatcatgaagaaccccaccgtcgacggcatcgtggccatcgacctcgaccccgtggtctacgacgcgaagttcgagaagcagctgggccagatcatgctgctcatcctgtgcacctcccagatcctgctcatgcggaccacgtgggccctgtgcgagagcatcaccctggccaccgggcccctcaccacgctgtgggagggctccccggggaagttctggaacaccaccatcgccgtgagcatggccaacatcttccgcggctcctacctggcgggcgccgggctcgccttcagcctgatgaagtccctgggcgggggccggcgcgggaccggcgcccagggcgagacgctcggggagaagtggaagcggcagctgaaccagctgagcaagagcgagttcaacacctacaagcgctccggcatcatggaggtggaccggagcgaggccaaggaggggctcaagcgcggcgagaccaccaagcacgcggtctcccgggggacggccaagctgcgctggttcgtggagcggaacctggtgaagcccgagggcaaggtcatcgacctgggctgcgggcgcggcgggtggagctactactgcgccggcctcaagaaggtgaccgaggtgaaggggtacaccaagggcggccccgggcacgaggagcccatcccgatggccacctacggctggaacatcgtcaagctgcactccgggcgggacgtgttcttcacgccgcccgagaagtgcgacacgctgctctgcgacatcggcgagagctcccccaacccgaccatcgaggaggggcgcaccctgcgggtgctgaagatggtcgagccctggctccgcggcaaccagttctgcatcaagatcctgaacccctacatgcccagcgtggtggagaccctggagcagatgcagcggaagcacggcgggatgctcgtccgcaacccgctgtcccggaacagcacgcacgagatgtactgggtgtcctgcggcaccgggaacatcgtgagcgcggtcaacatgacctcccgcatgctgctcaaccgcttcaccatggcccaccggaagcccacgtacgagcgcgacgtggacctgggcgccggcacccggcacgtggccgtcgagcccgagatcgccaacctggacatcatcgggcagcgcatcgagaacatcaagaacgagcacaagagcacctggcactacgacgaggacaacccctacaagacctgggcgtaccacggctcctacgaggtgaagccgagcgggtccgccagctccatggtgaacggcgtcgtgcggctcctgacgaagccctgggacgtcatccccatggtgacccagatcgccatgaccgacaccacgcccttcgggcagcagcgcgtgttcaaggagaaggtcgacacccggaccccgcgccccaagcggggcaccgcccagatcatggaggtgacggccaagtggctgtggggcttcctcagccgcaacaagaagccccggatctgcacccgcgaggagttcacccggaaggtgcgcagcaacgcggccatcggggccgtcttcgtggacgagaaccagtggaactccgccaaggaggccgtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaagatcccgggcggcaacatgtacgccgacgacacggccgggtgggacacccgcatcaccgaggacgacctgcagaacgaggccaagatcaccgacatcatggagcccgagcacgccctcctggcgacgtccatcttcaagctgacctaccagaacaaggtcgtgcgggtgcagcgccccgccaagagcggcaccgtcatggacgtgatctcccggcgcgaccagcgggggagcggccaggtgggcacctacgggctcaacacgttcaccaacatggaggtccagctgatccgccagatggagtccgagggcatcttcagcccctccgagctggagaacagcaacctcgccgagcgggtgctggactggctggagaagcacggggtggagcgcctcaagcggatggccatctccggcgacgactgcgtcgtgaagccgaccgacgaccgcttcgccaccgcgctgacggccctgaacgacatggggaaggtgcggaaggacatcccccagtgggagcccagcaagggctggaacgactggcagcaggtccccttctgctcccaccacttccaccagctcatcatgaaggacggccgcgagatcgtggtgccgtgccggaaccaggacgagctggtcgggcgcgcccgggtgagccagggcgccgggtggagcctgcgcgagaccgcctgcctcggcaagtcctacgcgcagatgtggcagctgatgtacttccaccggcgcgacctgcggctcgccgccaacgccatctgcagcgccgtgcccgtcaactgggtgcccacctcccgcaccacctggagcatccacgcgcaccaccagtggatgacgaccgaggacatgctgtccgtgtggaaccgcgtctggatcgaggagaacccctggatggaggacaagacccacgtgagctcctgggaggacgtgccgtacctggggaagcgggaggaccagtggtgcggcagcctcatcggcctgaccgcccgcgccacgtgggccaccaacatccaggtcgcgatcaaccaggtgcggcgcctgatcgggaacgagaactacctcgactacatgacctccatgaagcggttcaagaacgagagcgaccccgagggcgccctgtggtga

SEQ ID NO: 7952 - RNA, 9879 nt, synthetic construct
  misc_feature 1..9879: note = derived and/or modified CDS sequence (opt1) from DENV-1__KX380802__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagacctccgcgggggtgaacatgtgcaccctgatcgccatggacctgggcgagctctgcgaggacacgatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatgggcaagctcaccctgaagggggtctcctacgtgatgtgcaccggcagcttcaagctggagaaggaggtggcggagacccagcacggcacggtcctggtccaggtgaagtacgaggggaccgacgccccctgcaagatccccatctccacccaggacgagaagggcgtcacccagaacgggcggctcatcacggccaacccgatcgtgaccgacaaggagaagcccgtgaacatcgagaccgagccgcccttcggcgagagctacatcgtcatcggcgccggggagaaggcgctgaagctgtcctggttcaagaagggcagctccatcgggaagatgttcgaggccaccgcccgcggcgcccggcgcatggccatcctcggggacacggcgtgggacttcggcagcatcggcggggtgttcacctccgtgggcaagctggtccaccaggtgttcgggaccgcctacggcgtgctgttcagcggggtctcctggaccatgaagatcggcatcggcatcctcctgacgtggctggggctcaacagccgctccaccagcctgtccatgacctgcatcgccgtgggcatggtgaccctgtacctcggggtcatggtgcaggccgacagcggctgcgtgatcaactggaaggggcgggagctgaagtgcggctccggcatcttcgtcacgaacgaggtgcacacctggaccgagcagtacaagttccaggccgacagcccgaagcgcctgagcgcggccatcgggaaggcctgggaggagggcgtgtgcgggatccggtccgccacccgcctcgagaacatcatgtggaagcagatcagcaacgagctgaaccacatcctgctcgagaacgacatgaagttcaccgtcgtggtgggcgacgccaacgggatcctgacgcagggcaagaagatgatccggccccagcccatggagcacaagtactcctggaagtcctggggcaaggcgaagatcatcggggccgacacccagaacaccaccttcatcatcgacggccccgacacgccggagtgccccgacgaccagcgcgcctggaacatctgggaggtcgaggactacgggttcggcgtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggggtgctggagagcgagatgatcatccccaagatctacggcgggccgatctcccagcacaactaccggcccggctacttcacccagacggcggggccctggcacctgggcaagctcgagctggacttcaacctgtgcgagggcaccaccgtggtcgtggacgagcactgcgggaaccgcggcccgagcctccggaccacgaccgtgaccgggaagatcatccacgagtggtgctgccgctcctgcaccctgccgcccctgcggttccgcggcgaggacgggtgctggtacggcatggagatccggcccgtcaaggagaaggaggagaacctcgtgcgcagcatggtgtccgccggcagcggggaggtcgacagcttctccctgggcctgctctgcgtgagcatcatgatcgaggaggtgatgcggtcccgctggagccgcaagatgctgatgacggggaccctggccgtcttcttcctcctgatcatgggccagctgacctggaacgacctcatccggctgtgcatcatggtgggggccaacgtgtccgaccgcatgggcatgggcaccacgtacctggccctcatggcgaccttcaagatgcggccgatgttcgccgtcgggctgctgttccgccggctcaccagccgcgaggtgctgctgctcaccatcggcctgtccctggtcgccagcgtggagctccccaactccctggaggagctgggggacggcctcgccatgggcatcatgatgctgaagctgctcacggacttccagagccaccagctgtggaccaccctgctctccctgaccttcatcaagacgaccctgagcctcgactacgcctggaagaccatggcgatggtgctgtccatcgtcagcctgttccccctctgcctgtccaccacgagccagaagaccacctggctgcccgtgctcctggggtccttcggctgcaagccgctgaccatgttcctcatcaccgagaacaagatctgggggcgcaagagctggcccctgaacgagggcatcatggccgtggggatcgtctccatcctgctcagcagcctgctgaagaacgacgtgcccctcgccggccccctgatcgccggcgggatgctgatcgcgtgctacgtgatctccggcagctccgccgacctcagcctggagcgcgccgccgaggtctcctgggaggaggaggccgagcacagcggggcgtcccacaacatcctggtggaggtgcaggacgacggcacgatgaagatcaaggacgaggagcgggacgacaccctcaccatcctgctgaaggccaccctcctggccgtcagcggggtgtacccgatgtccatccccgccacgctgttcgtgtggtacttctggcagaagaagaagcagcgcagcggcgtcctctgggacacccccagcccgcccgaggtggagcgggccgtgctggacgacggcatctaccgcatcctgcagcgggggctgctcggccgcagccaggtcggggtgggcgtgttccaggacggggtcttccacaccatgtggcacgtgacccggggcgcggtgctgatgtaccagggcaagcgcctggagccctcctgggccagcgtcaagaaggacctcatctcctacgggggcgggtggcggttccagggcagctggaacacgggggaggaggtccaggtgatcgccgtcgagcccggcaagaaccccaagaacgtgcagaccacccccggcaccttcaagacgcccgagggggaggtgggcgccatcgccctggacttcaagcccgggacctccggcagccccatcgtcaaccgcgagggcaagatcgtggggctgtacggcaacggggtggtcaccacctccggcacgtacgtgagcgcgatcgcccaggccaaggccagccaggaggggccgctccccgagatcgaggacgaggtgttcaagaagcggaacctgaccatcatggacctgcaccccggctccggcaagacccgccggtacctcccggccatcgtccgcgaggcgatcaagcgcaagctgcggaccctgatcctcgcccccacgcgcgtggtggccagcgagatggccgaggcgctgaaggggatgcccatccggtaccagaccaccgccgtcaagtccgagcacaccggcaaggagatcgtggacctgatgtgccacgccacgttcaccatgcgcctcctgagccccgtgcgggtcccgaactacaacatgatcatcatggacgaggcccacttcaccgaccccgcctccatcgcggcccgcgggtacatcagcacccgggtgggcatgggggaggccgccgccatcttcatgacggcgacgccgcccggctccgtggaggccttcccgcagagcaacgccgtcatccaggacgaggagcgcgacatccccgagcggtcctggaacagcggctacgactggatcaccgacttccccgggaagaccgtgtggttcgtgccctccatcaagagcggcaacgacatcgccaactgcctgcgcaagaacgggaagcgggtcatccagctctcccgcaagacgttcgacaccgagtaccagaagaccaagaacaacgactgggactacgtggtgaccacggacatcagcgagatgggcgccaacttccgggcggaccgcgtcatcgacccgcggcgctgcctgaagcccgtgatcctgaaggacgggcccgagcgggtcatcctcgccggccccatgccggtgaccgccgcctccgcggcccagcgccggggccgcatcgggcgcaaccagaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgcggccatcgacggggagtaccgcctgcggggcgaggcccgcaagacgttcgtggagctcatgcggcgcggcgacctgcccgtctggctgtcctacaaggtggccagcgaggggttccagtactccgaccggcgctggtgcttcgacggcgagcggaacaaccaggtgctcgaggagaacatggacgtcgagatctggaccaaggagggggagcgcaagaagctgcggccccgctggctggacgcccggacctacagcgaccccctcgcgctgcgcgagttcaaggagttcgccgccggccggcgcagcgtgtccggcgacctgatcctcgagatcgggaagctgccgcagcacctgaccctccgggcccagaacgccctggacaacctggtgatgctccacaacagcgagcagggcgggaaggcgtaccgccacgccatggaggagctgcccgacaccatcgagacgctgatgctcctggccctgatcgccgtcctcaccggcggggtgaccctgttcttcctgtccggcaagggcctcgggaagaccagcatcggcctgctgtgcgtgatggcgtccagcgtcctcctgtggatggcctccgtggagccccactggatcgccgccagcatcatcctggagttcttcctcatggtgctgctgatccccgagccggaccggcagcgcacgccccaggacaaccagctcgcctacgtcgtgatcgggctgctgttcatgatcctcaccgtggcggccaacgagatgggcctgctggagaccaccaagaaggacctcgggatcggccacgtcgtggccgagaaccaccaccacgccacgatgctggacatcgacctgcaccccgcctccgcgtggaccctctacgccgtggccaccaccatcatcacgccgatgatgcggcacaccatcgagaacaccaccgccaacatcagcctgacggccatcgcgaaccaggccgccatcctgatgggcctcgacaaggggtggcccatctccaagatggacatcggcgtccccctgctggccctcgggtgctacagccaggtgaaccccctgaccctgaccgccgcggtgctcatgctggtcgcccactacgccatcatcggcccggggctgcaggccaaggcgacccgcgaggcccagaagcgcacggccgccggcatcatgaagaaccccaccgtggacggcatcgtggccatcgacctcgaccccgtcgtgtacgacgcgaagttcgagaagcagctggggcagatcatgctgctcatcctgtgcacctcccagatcctgctcatgcggaccacgtgggccctgtgcgagagcatcaccctggccaccggccccctcaccacgctgtgggaggggtccccgggcaagttctggaacaccaccatcgccgtgagcatggccaacatcttccgcggctcctacctggcgggggccggcctcgccttcagcctgatgaagtccctcgggggcgggcggcgcgggaccggcgcccagggggagacgctcggcgagaagtggaagcggcagctgaaccagctgagcaagagcgagttcaacacctacaagcgctccgggatcatggaggtcgaccggagcgaggccaaggagggcctcaagcgcggggagaccaccaagcacgcggtgtcccggggcacggccaagctgcgctggttcgtggagcggaacctggtcaagcccgagggcaaggtgatcgacctggggtgcggccgcgggggctggagctactactgcgccgggctcaagaaggtgaccgaggtcaagggctacaccaagggcgggcccggccacgaggagcccatcccgatggccacctacgggtggaacatcgtgaagctgcactccggccgggacgtgttcttcacgccgcccgagaagtgcgacacgctgctctgcgacatcggggagagctcccccaacccgaccatcgaggagggccgcaccctgcgggtcctgaagatggtggagccctggctccgcggcaaccagttctgcatcaagatcctgaacccctacatgcccagcgtggtcgagaccctggagcagatgcagcggaagcacgggggcatgctcgtgcgcaacccgctgtcccggaacagcacgcacgagatgtactgggtgtcctgcgggaccggcaacatcgtcagcgcggtgaacatgacctcccgcatgctgctcaaccgcttcaccatggcccaccggaagcccacgtacgagcgcgacgtggacctgggcgccgggacccggcacgtcgccgtggagcccgagatcgccaacctggacatcatcggccagcgcatcgagaacatcaagaacgagcacaagagcacctggcactacgacgaggacaacccctacaagacctgggcgtaccacgggtcctacgaggtgaagccgagcggctccgccagctccatggtcaacggggtggtccggctcctgacgaagccctgggacgtgatccccatggtgacccagatcgccatgaccgacaccacgcccttcggccagcagcgcgtcttcaaggagaaggtggacacccggaccccgcgccccaagcggggcaccgcccagatcatggaggtgacggccaagtggctgtgggggttcctcagccgcaacaagaagccccggatctgcacccgcgaggagttcacccggaaggtccgcagcaacgcggccatcggcgccgtgttcgtggacgagaaccagtggaactccgccaaggaggccgtcgaggacgagcggttctgggacctggtgcaccgcgagcgggagctgcacaagcaggggaagtgcgcgacctgcgtgtacaacatgatgggcaagcgcgagaagaagctcggggagttcggcaaggccaagggcagccgggccatctggtacatgtggctgggggcccgcttcctggagttcgaggcgctcggcttcatgaacgaggaccactggttctcccgggagaacagcctgtccggggtcgagggcgaggggctgcacaagctcggctacatcctgcgcgacatcagcaagatcccgggcgggaacatgtacgccgacgacacggccggctgggacacccgcatcaccgaggacgacctgcagaacgaggccaagatcaccgacatcatggagcccgagcacgccctcctggcgacgtccatcttcaagctgacctaccagaacaaggtggtgcgggtccagcgccccgccaagagcgggaccgtgatggacgtgatctcccggcgcgaccagcggggcagcggccaggtcgggacctacggcctcaacacgttcaccaacatggaggtgcagctgatccgccagatggagtccgaggggatcttcagcccctccgagctggagaacagcaacctcgccgagcgggtgctggactggctggagaagcacggcgtcgagcgcctcaagcggatggccatctccggggacgactgcgtggtgaagccgaccgacgaccgcttcgccaccgcgctgacggccctgaacgacatgggcaaggtccggaaggacatcccccagtgggagcccagcaagggctggaacgactggcagcaggtccccttctgctcccaccacttccaccagctcatcatgaaggacgggcgcgagatcgtggtcccgtgccggaaccaggacgagctggtgggccgcgcccgggtgagccagggggccggctggagcctgcgcgagaccgcctgcctcgggaagtcctacgcgcagatgtggcagctgatgtacttccaccggcgcgacctgcggctcgccgccaacgccatctgcagcgccgtccccgtgaactgggtgcccacctcccgcaccacctggagcatccacgcgcaccaccagtggatgacgaccgaggacatgctgtccgtctggaaccgcgtgtggatcgaggagaacccctggatggaggacaagacccacgtgagctcctgggaggacgtcccgtacctgggcaagcgggaggaccagtggtgcggcagcctcatcgggctgaccgcccgcgccacgtgggccaccaacatccaggtggcgatcaaccaggtgcggcgcctgatcggcaacgagaactacctcgactacatgacctccatgaagcggttcaagaacgagagcgaccccgagggggccctgtggtga

SEQ ID NO: 7953 - RNA, 9879 nt, synthetic construct
  misc_feature 1..9879: note = derived and/or modified CDS sequence (opt1) from DENV-1__KX380797__SS-prME
  source 1..9879: mol_type = other RNA
agcgtgaccgtgctgctcatgctgctgcccaccgccctcgccttccacctgaccacccgcggcggggagccccacatgatcgtgagcaagcaggagcggggcaagagcctgctgttcaagacctccaccggggtgaacatgtgcaccctgatcgcgatggacctgggcgagctctgcgaggacaccatgacctacaagtgcccccgcatcaccgagaccgagcccgacgacgtggactgctggtgcaacgccaccgagacctgggtgacctacgggacctgcagccagaccggcgagcaccggcgcgacaagcggtccgtggccctggcgccccacgtcggcctggggctcgagacccgcaccgagacctggatgagctccgagggcgcctggcggcagatccagaaggtggagacctgggccctgcgccaccccgggttcaccgtgatcgccctgttcctcgcccacgccatcggcaccagcatcacgcagaaggggatcatcttcatcctgctgatgctcgtcaccccctccatggcgatgcggtgcgtgggcatcggcaaccgcgacttcgtggaggggctgagcggcgccacctgggtcgacgtggtgctggagcacgggtcctgcgtcaccacgatggccaaggacaagcccaccctcgacatcgagctgctgaagaccgaggtgaccaaccccgccgtgctccggaagctgtgcatcgaggccaagatcagcaacacgaccaccgactcccgctgccccacccagggcgaggcgacgctggtcgaggagcaggacaccaacttcgtgtgccggcgcaccctcgtggaccggggctgggggaacggctgcgggctgttcggcaaggggagcctgatcacgtgcgccaagttcaagtgcgtcacgaagctcgagggcaagatcgtgcagtacgagaacctgaagtactccgtgatcgtcaccgtgcacaccggcgaccagcaccaggtcgggaacgagaccaccgagcacggcacgaccgccaccatcacgccccaggcccccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggcgagcaccagccaggagacctggaaccggcaggacctcctggtcacgttcaagaccgcccacgccaagaagcaggaggtggtggtcctgggctcccaggagggcgccatgcacaccgccctcaccggggcgacggagatccagaccagcggcaccaccacgatcttcgccgggcacctgaagtgccgcctgaagatggacaagctcaccctgaagggcgtgtcctacgtgatgtgcaccgggagcttcaagctggagaaggaggtcgccgagacccagcacggcacggtgctggtgcaggtcaagtacgagggcaccgacgccccctgcaagatccccttcacctcccaggacgagaagggggtgacccagaacggccggctcatcacggccaacccgatcgtgaccgacaaggagaagcccgtcaacatcgaggcggagccgcccttcggggagagctacctggtggtgggcgccggcgagaaggccctgaagctctcctggttcaagaaggggagctccatcggcaagatgttcgaggccaccgcgcgcggggcccggcgcatggccatcctgggcgacaccgcctgggacttcgggagcatcggcggcgtcttcacgtccgtggggaagctgatccaccagatcttcggcaccgcctacggggtcctcttcagcggcgtctcctggaccatgaagatcgggatcggcatcctgctgacctggctcggcctgaacagccgctccacgagcctgtccatgacctgcatcgcggtggggatggtgaccctctacctgggcgtcatggtgcaggccgacagcgggtgcgtgatcaactggaagggccgggagctgaagtgcgggtccggcatcttcgtcaccaacgaggtgcacacctggacggagcagtacaagttccaggccgacagcccgaagcgcctcagcgccgccatcggcaaggcgtgggaggagggggtgtgcggcatccggtccgccacccgcctggagaacatcatgtggaagcagatcagcaacgagctgaaccacatcctcctggagaacgacatgaagttcaccgtcgtggtgggggacgtcaacggcatcctggcccaggggaagaagatgatccggccccagcccatggagcacaagtactcctggaagtcctggggcaaggccaaggtgatcggcgccgacgtgcagaactccaccttcatcatcgacgggcccaacacgccggagtgccccgacgaccagcgcgcgtggaacatctgggaggtcgaggactacggcttcgggatcttcaccaccaacatctggctcaagctgcgggacagctacacccaggtgtgcgaccaccgcctgatgtccgccgccatcaaggacagcaaggccgtgcacgcggacatgggctactggatcgagtccgagaagaacgagacgtggaagctcacccgggccagcttcatcgaggtcaagacctgcgtgtggcccaagtcccacaccctgtggagcaacggcgtgctggagtccgagatgatcatccccaagatctacgggggcccgatcagccagcacaactaccgccccgggtacttcacgcagaccgccggcccctggcacctcgggaagctggagctggacttcggcctctgcgagggcaccaccgtcgtggtggacgagcactgcgggaaccggggcccgtccctgcgcacgaccaccgtcaccgggaagatcatccacgagtggtgctgccggagctgcacgctgccgcccctccgcttcaagggcgaggacgggtgctggtacggcatggagatccggcccgtgaaggagaaggaggagaacctggtgaagtccatggtcagcgccggcagcggggaggtggactccttcagcctgggcctcctgtgcatctccatcatgatcgaggaggtgatgcgcagccggtggtcccgcaagatgctgatgaccgggaccctcgccgtcttcctgctgctcatcatgggccagctgacctggaacgacctgatccggctctgcatcatggtgggggcgaacgccagcgacaagatgggcatgggcacgacctacctggccctgatggccaccttccgcatgcgcccgatgttcgccgtcgggctcctgttccggcgcctgacctcccgggaggtgctcctgcgcagcgtgggcctgtccctcgtcgcgagcgtggagctgcccaactccctggaggagctcggggacggcctggccatgggcatcatgatgctgaagctcctgacggacttccagagccaccagctgtgggccgccctcctgtccctgaccttcgtgaagaccaccttcagcctccactacgcctggaagacgatggcgatgatcctgtccatcgtcagcctgttccccctctgcctgtccaccaccagccagaagaccacgtggctgcccgtgctcctggggtccctgggctgcaagccgctcaccatgttcctgatcaccgagaacaagatctgggggcgcaagagctggcccctgaacgagggcatcatggccgtggggatcgtcagcatcctcctgtccagcctgctcaagaacgacgtgcccctggccggccccctgatcgccggcgggatgctcatcgcgtgctacgtgatctccggcagctccgccgacctgagcctggagaaggccgccgaggtctcctgggaggaggaggccgagcacagcggggcgtcccacaacatcctcgtggaggtgcaggacgacggcaccatgaagatcaaggacgaggagcgcgacgacaccctgacgatcctgctcaaggccaccctgctggccatcagcggggtctacccgatgtccatccccgccaccctcttcgtgtggtacttctggcagaagaagaagcagcggagcggcgtgctgtgggacacccccagcccgcccgaggtcgagcgcgccgtgctggacgacggcatctaccggatcctgcagcgcgggctcctgggcaagagccaggtgggggtcggcgtgttccaggagggggtgttccacacgatgtggcacgtcacccggggcgcggtgctgatgtaccagggcaagcgcctcgagccctcctgggccagcgtgaagaaggacctgatctcctacgggggcgggtggcggttccagggcagctggaacaccggggaggaggtccaggtgatcgccgtggagcccggcaagaaccccaagaacgtccagaccgcccccggcacgttcaagacccccgagggggaggtgggcgccatcgcgctggacttcaagcccgggacctccggcagccccatcgtgaaccgcgagggcaagatcgtcgggctctacggcaacggggtggtgaccacgagcggcacctacgtctccgccatcgcccaggccaaggccagccaggaggggccgctgcccgagatcgaggacgaggtgttccggaagcgcaacctgaccatcatggacctccaccccggctccggcaagacccggcgctacctgccggcgatcgtgcgggaggccatcaagcgcaagctgcggacgctcgtcctggcccccacccgcgtggtggccagcgagatggcggaggccctgaaggggatgcccatccgctaccagaccaccgccgtcaagtccgagcacacgggcaaggagatcgtggacctcatgtgccacgccaccttcaccatgcggctgctgagccccgtgcgcgtcccgaactacaacatgatcatcatggacgaggcccacttcaccgaccccgcgtccatcgccgcccgggggtacatcagcacgcgcgtgggcatgggggaggccgccgcgatcttcatgaccgccacgccgcccggctccatggaggccttcccgcagagcaacgccgccatccaggacgaggagcgggacatccccgagcgctcctggaacagcggctacgactggatcaccgacttccccgggaagacggtgtggttcgtcccctccatcaagagcggcaacgacatcgcgaactgcctccggaagaacgggaagcgcgtggtgcagctgtcccggaagaccttcgacaccgagtaccagaagaccaagaacaacgactgggactacgtcgtgacgaccgacatcagcgagatgggcgccaacttccgcgccgaccgggtcatcgacccgcgccggtgcctgaagcccgtgatcctcaaggacgggcccgagcgcgtgatcctggccggccccatgccggtcaccgtggcgtccgccgcccagcggcgcggccggatcgggcgcaaccagaacaaggagggcgaccagtacatctacatggggcagcccctgaacaacgacgaggaccacgcccactggaccgaggccaagatgctcctggacaacatcaacacgcccgagggcatcatccccgcgctgttcgagccggagcgggagaagtccgccgccatcgacggggagtaccgcctccgcggcgaggcccggaagaccttcgtggagctgatgcgccggggcgacctgcccgtctggctctcctacaaggtggccagcgaggggttccagtacagcgaccgccggtggtgcttcgacggcgagcgcaacaaccaggtgctggaggagaacatggacgtcgagatctggaccaaggagggggagcggaagaagctgcgcccccggtggctcgacgcgcgcacctactccgaccccctggccctgcgggagttcaaggagttcgccgccggccgccggagcgtgtccggcgacctcatcctggagatcgggaagctgccgcagcacctcacgcagcgcgcccagaacgcgctggacaacctggtgatgctccacaacagcgagcagggcgggaaggcctaccggcacgccatggaggagctgcccgacaccatcgagaccctgatgctcctggccctgatcgcggtcctcaccggcggggtgaccctgttcttcctgtccggccgcggcctcgggaagacgagcatcggcctgctgtgcgtgatggcctccagcgccctcctgtggatggcctccgtcgagccccactggatcgccgcgagcatcatcctggagttcttcctcatggtgctgctgatccccgagccggaccggcagcgcacgccccaggacaaccagctcgcctacgtggtcatcgggctgctgttcatgatcctcaccgtggccgccaacgagatgggcctgctggagaccacgaagaaggacctcgggatcggccacgtggccgcggagtcccaccaccacgccgccatgctggacgtcgacctgcaccccgccagcgcctggaccctctacgcggtggccaccaccatcatcacgccgatgatgcggcacaccatcgagaacaccaccgccaacatctccctgacggccatcgccaaccaggcggccatcctgatgggcctcgacaaggggtggcccatcagcaagatggacatcggcgtgcccctgctggccctcgggtgctactcccaggtcaaccccctgaccctgaccgccgcggtgctcatgctggtggcccactacgccatcatcggcccggggctgcaggccaaggccacccgcgaggcgcagaagcggacggccgccggcatcatgaagaaccccaccgtcgacggcatcgtggccatcgacctcgaccccgtggtctacgacgccaagttcgagaagcagctggggcagatcatgctgctcatcctgtgcaccagccagatcctgctcatgcgcaccacgtgggcgctgtgcgagtccatcaccctggccaccggccccctcaccacgctgtgggaggggagcccgggcaagttctggaacaccaccatcgccgtgtccatggccaacatcttccgcggcagctacctggccggggcgggcctcgccttcagcctgatgaagtccctcgggggcgggcggcgcgggaccggcgcccagggggagacgctcggcgagaagtggaagcggcagctgaaccagctgaccaagagcgagttcaacacctacaagcgctccgggatcatcgaggtggaccggagcgaggccaaggagggcctcaagcgcggggagaccacgaagcacgcggtctcccggggcaccgccaagctgcgctggttcgtggagcggaacctggtgaagcccgagggcaaggtcatcgacctggggtgcggccgcgggggctggagctactactgcgccgggctcaagaaggtgaccgaggtgaagggctacaccaagggcgggcccggccacgaggagcccatcccgatggccacgtacgggtggaacctggtcaagctgtactccggcaaggacgtgttcttcacgccgcccgagaagtgcgacaccctcctgtgcgacatcggggagagctcccccaacccgaccatcgaggagggccggaccctgcgcgtgctcaagatggtcgagccctggctgcggggcaaccagttctgcatcaaggtgctgaacccctacatgcccagcgtggtcgagacgctcgagcagatgcagcgcaagcacgggggcatgctggtgcggaacccgctgtcccgcaacagcacccacgagatgtactgggtgtcctgcgggaccggcaacatcgtcagcgccgtgaacatgacctcccggatgctcctgaaccgcttcacgatggcgcaccggaagcccacctacgagcgcgacgtggacctgggcgccgggacccgccacgtcgccgtggagcccgaggtcgccaacctcgacatcatcggccagcggatcgagaacatcaagaacgagcacaagagcacctggcactacgacgaggacaacccctacaagacgtgggcctaccacgggtcctacgaggtgaagccgagcggctccgcgagcagcatggtgaacggggtcgtgcgcctgctgaccaagccctgggacgtgatccccatggtcacccagatcgccatgaccgacacgacccccttcggccagcagcgggtgttcaaggagaaggtggacacccgcaccccgaaggccaagcggggcacggcccagatcatggaggtcaccgcccgctggctctgggggttcctgtcccggaacaagaagccccgcatctgcacccgggaggagttcacccgcaaggtgcggagcaacgcggccatcggcgccgtgttcgtcgacgagaaccagtggaactccgccaaggaggcggtggaggacgagcgcttctgggacctggtgcaccgggagcgcgagctccacaagcaggggaagtgcgccacgtgcgtctacaacatgatgggcaagcgggagaagaagctgggggagttcggcaaggccaagggcagccgcgccatctggtacatgtggctgggggcccggttcctcgagttcgaggcgctgggcttcatgaacgaggaccactggttctcccgcgagaacagcctgtccggggtggagggcgaggggctccacaagctgggctacatcctgcgggacatcagcaagatccccggcgggaacatgtacgccgacgacaccgccggctgggacacccgcatcaccgaggacgacctccagaacgaggccaagatcacggacatcatggagccggagcacgccctgctggcgacctccatcttcaagctcacctaccagaacaaggtggtccgggtgcagcgccccgccaagaacgggaccgtgatggacgtcatcagccgccgggaccagcgcggctccggccaggtggggacgtacggcctgaacaccttcaccaacatggaggcccagctgatccggcagatggagagcgaggggatcttcctcccctccgagctggagacccccaacctggccgagcgcgtgctcgactggctggagaagtacggcatcgagcggctgaagcgcatggccatcagcggggacgactgcgtcgtgaagccggtggacgaccggttcgcgacggccctcaccgccctgaacgacatgggcaaggtccgcaaggacatcccccagtgggagccctccaagggctggaacgactggcagcaggtccccttctgcagccaccacttccaccagctgatcatgaaggacgggcgggagatcgtggtcccgtgccgcaaccaggacgagctcgtgggccgggcccgcgtgtcccagggggccggctggagcctgcgggagaccgcgtgcctgggcaagagctacgcccagatgtggcagctcatgtacttccaccgccgggacctgcgcctggccgccaacgcgatctgctccgccgtccccgtggactgggtgcccaccagccggacgacctggtccatccacgcccaccaccagtggatgaccaccgaggacatgctcagcgtctggaaccgcgtgtggatcgaggagaacccctggatggaggacaagacccacgtgtccagctgggaggacgtcccgtacctgggcaagcgggaggaccagtggtgcggctccctgatcgggctcacggcccgcgccacctgggcgaccaacatccaggtggccatcaaccaggtgcgccggctgatcggcaacgagaactacctggactacatgaccagcatgaagcgcttcaagaacgagtccgaccccgagggggccctctggtga

SEQ ID NO: 7954 - RNA, 9879 nt, synthetic construct
  misc_feature 1..9879: note = derived and/or modified CDS sequence (opt1) from DENV-1__KX380805__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgcgggggtgaacatgtgcaccctgatcgccatggacctgggcgagctctgcgaggacacgatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggcggcagatccagaaggtggagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcgtctcctacgtgatgtgcaccgggagcttcaagctggagaaggaggtggcggagacccagcacggcacggtcctggtccaggtgaagtacgagggcaccgacgccccctgcaagatccccatctccacccaggacgagaagggggtcacccagaacggccggctcatcacggccaacccgatcgtgaccgacaaggagaagcccgtgaacatcgagaccgagccgcccttcggggagagctacatcgtcatcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctgacgcaggggaagaagatgatccggccccagcccatggagcacaagtactcctggaagtcctggggcaaggcgaagatcatcggcgccgacacccagaacaccaccttcatcatcgacgggcccgacacgccggagtgccccgacgaccagcgcgcctggaacatctgggaggtcgaggactacggcttcggggtgttcaccaccaacatctggctgaagctccgggactcctacacccagatgtgcgaccaccgcctgatgagcgccgcgatcaaggactccaaggccgtgcacgccgacatgggctactggatcgagagcgagaagaacgagacgtggaagctggcccgggcctccttcatcgaggtcaagacctgcatctggccccgcagccacaccctctggtccaacggcgtgctggagagcgagatgatcatccccaagatctacgggggcccgatctcccagcacaactaccggcccgggtacttcacccagacggcgggcccctggcacctggggaagctcgagctggacttcaacctgtgcgagggcaccaccgtggtcgtggacgagcactgcggcaaccgcgggccgagcctccggaccacgaccgtgaccggcaagatcatccacgagtggtgctgccgctcctgcaccctgccgcccctgcggttccgcggggaggacggctgctggtacgggatggagatccggcccgtcaaggagaaggaggagaacctcgtgcgcagcatggtgtccgccggcagcggcgaggtcgacagcttctccctggggctgctcagcgtgtccatcatgatcgaggaggtgatgcggagccgctggtcccgcaagatgctgatgacgggcaccctggccgtcttcttcctcctgatcatggggcagctgacctggaacgacctcatccggctgtgcatcatggtgggcgccaacgtgagcgaccgcatggggatgggcaccacgtacctggccctcatggcgaccttcaagatgcggccgatgttcgccgtcgggctgctgttccgccggctcacctcccgcgaggtgctgctgctcaccatcgggctgagcctggtcgcctccgtggagctccccaacagcctggaggagctgggcgacgggctcgccatgggcatcatgatgctgaagctgctcacggacttccagtcccaccagctgtggaccaccctgctcagcctgaccttcatcaagacgaccctgtccctcgactacgcctggaagaccatggcgatggtgctgagcatcgtctccctgttccccctctgcctgagcaccacgtcccagaagaccacctggctgcccgtgctcctgggcagcttcgggtgcaagccgctgaccatgttcctcatcaccgagaacaagatctggggccggaagtcctggcccctgaacgaggggatcatggccgtgggcatcgtcagcatcctgctcagctccctgctgaagaacgacgtgcccctcgccgggcccctgatcgccggcggcatgctgatcgcgtgctacgtgatcagcgggtccagcgccgacctctccctggagcgcgccgccgaggtcagctgggaggaggaggccgagcactccggcgcgagccacaacatcctggtggaggtgcaggacgacgggacgatgaagatcaaggacgaggagcgggacgacaccctcaccatcctgctgaaggccaccctcctggccgtctccggcgtgtacccgatgagcatccccgccacgctgttcgtgtggtacttctggcagaagaagaagcagcgctccggggtcctctgggacacccccagcccgcccgaggtggagcgggccgtgctggacgacggcatctaccgcatcctgcagcggggcctgctcgggcgctcccaggtcggcgtgggggtgttccaggacggcgtcttccacaccatgtggcacgtgacccgcggggcggtgctgatgtaccagggcaagcgcctggagcccagctgggcctccgtcaagaaggacctcatcagctacggcgggggctggcggttccaggggtcctggaacacgggcgaggaggtccaggtgatcgccgtcgagcccgggaagaaccccaagaacgtgcagaccacccccggcaccttcaagacgcccgagggcgaggtgggggccatcgccctggacttcaagcccggcaccagcgggtcccccatcgtcaaccgcgagggcaagatcgtgggcctgtacgggaacggcgtggtcaccaccagcgggacgtacgtgagcgcgatcgcccaggccaaggcctcccaggagggcccgctccccgagatcgaggacgaggtgttcaagaagcggaacctgaccatcatggacctgcaccccgggagcggcaagacccgccggtacctcccggccatcgtccgcgaggcgatcaagcgcaagctgcggaccctgatcctcgcccccacgcgcgtggtggcctccgagatggccgaggcgctgaagggcatgcccatccggtaccagaccaccgccgtcaagagcgagcacaccgggaaggagatcgtggacctgatgtgccacgccacgttcaccatgcgcctcctgtcccccgtgcgggtcccgaactacaacatgatcatcatggacgaggcccacttcaccgaccccgccagcatcgcggcccgcggctacatctccacccgggtggggatgggcgaggccgccgccatcttcatgacggcgacgccgcccgggagcgtggaggccttcccgcagtccaacgccgtcatccaggacgaggagcgcgacatccccgagcggagctggaactccggctacgactggatcaccgacttccccggcaagaccgtgtggttcgtgcccagcatcaagtccgggaacgacatcgccaactgcctgcgcaagaacggcaagcgggtcatccagctcagccgcaagacgttcgacaccgagtaccagaagaccaagaacaacgactgggactacgtggtgaccacggacatctccgagatgggggccaacttccgggcggaccgcgtcatcgacccgcggcgctgcctgaagcccgtgatcctgaaggacggccccgagcgggtcatcctcgccgggcccatgccggtgaccgccgccagcgcggcccagcgccggggccgcatcggccgcaaccagaacaaggagggggaccagtacatctacatgggccagcccctgaacaacgacgaggaccacgcccactggaccgaggccaagatgctgctcgacaacatcaacacccccgaggggatcatccccgccctgttcgagccggagcgggagaagtccgcggccatcgacggcgagtaccgcctgcgcggggaggcccgcaagacgttcgtggagctcatgcggcgcggcgacctgcccgtctggctgagctacaaggtggcctccgagggcttccagtacagcgaccggcgctggtgcttcgacggggagcggaacaaccaggtgctcgaggagaacatggacgtcgagatctggaccaaggagggcgagcgcaagaagctgcggccccgctggctggacgcccggacctacagcgaccccctcgcgctgcgcgagttcaaggagttcgccgccgggcggcgctccgtgagcggcgacctgatcctcgagatcggcaagctgccgcagcacctgaccctccgggcccagaacgccctggacaacctggtgatgctccacaactccgagcagggcgggaaggcgtaccgccacgccatggaggagctgcccgacaccatcgagacgctgatgctcctggccctgatcgccgtcctcaccgggggcgtgaccctgttcttcctgagcgggaagggcctcggcaagacctccatcgggctgctgtgcgtgatggcgagctccgtcctcctgtggatggccagcgtggagccccactggatcgccgcctccatcatcctggagttcttcctcatggtgctgctgatccccgagccggaccggcagcgcacgccccaggacaaccagctcgcctacgtcgtgatcggcctgctgttcatgatcctcaccgtggcggccaacgagatggggctgctggagaccaccaagaaggacctcggcatcgggcacgtcgtggccgagaaccaccaccacgccacgatgctggacatcgacctgcaccccgccagcgcgtggaccctctacgccgtggccaccaccatcatcacgccgatgatgcggcacaccatcgagaacaccaccgccaacatctccctgacggccatcgcgaaccaggccgccatcctgatgggcctcgacaagggctggcccatcagcaagatggacatcggggtccccctgctggccctcggctgctactcccaggtgaaccccctgaccctgaccgccgcggtgctcatgctggtcgcccactacgccatcatcgggccgggcctgcaggccaaggcgacccgcgaggcccagaagcgcacggccgccgggatcatgaagaaccccaccgtggacggcatcgtggccatcgacctcgaccccgtcgtgtacgacgcgaagttcgagaagcagctgggccagatcatgctgctcatcctgtgcaccagccagatcctgctcatgcggaccacgtgggccctgtgcgagtccatcaccctggccaccgggcccctcaccacgctgtgggagggcagcccggggaagttctggaacaccaccatcgccgtgtccatggccaacatcttccgcggcagctacctggcgggcgccgggctcgccttctccctgatgaagtccctgggcgggggccggcgcgggaccggcgcccagggcgagacgctcggggagaagtggaagcggcagctgaaccagctgagcaagtccgagttcaacacctacaagcgcagcggcatcatggaggtcgaccggtccgaggccaaggaggggctcaagcgcggcgagaccaccaagcacgcggtgagccgggggacggccaagctgcgctggttcgtggagcggaacctggtcaagcccgagggcaaggtgatcgacctgggctgcgggcgcggcgggtggtcctactactgcgccggcctcaagaaggtgaccgaggtcaaggggtacaccaagggcggccccgggcacgaggagcccatcccgatggccacctacggctggaacatcgtgaagctgcacagcgggcgggacgtgttcttcacgccgcccgagaagtgcgacacgctgctctgcgacatcggcgagtccagccccaacccgaccatcgaggaggggcgcaccctgcgggtcctgaagatggtggagccctggctccgcggcaaccagttctgcatcaagatcctgaacccctacatgccctccgtggtcgagaccctggagcagatgcagcggaagcacggcgggatgctcgtgcgcaacccgctgagccggaactccacgcacgagatgtactgggtgagctgcggcaccgggaacatcgtctccgcggtgaacatgaccagccgcatgctgctcaaccgcttcaccatggcccaccggaagcccacgtacgagcgcgacgtggacctgggcgccggcacccggcacgtcgccgtggagcccgagatcgccaacctggacatcatcgggcagcgcatcgagaacatcaagaacgagcacaagtccacctggcactacgacgaggacaacccctacaagacctgggcgtaccacggcagctacgaggtgaagccgtccgggagcgcctccagcatggtcaacggcgtggtccggctcctgacgaagccctgggacgtgatccccatggtgacccagatcgccatgaccgacaccacgcccttcgggcagcagcgcgtcttcaaggagaaggtggacacccggaccccgcgccccaagcggggcaccgcccagatcatggaggtgacggccaagtggctgtggggcttcctcagccgcaacaagaagccccggatctgcacccgcgaggagttcacccggaaggtccgctccaacgcggccatcggggccgtgttcgtggacgagaaccagtggaacagcgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggccaagggctcccgggccatctggtacatgtggctgggcgcccgcttcctggagttcgaggcgctcgggttcatgaacgaggaccactggttcagccgggagaactccctgagcggcgtcgagggggagggcctgcacaagctcgggtacatcctgcgcgacatctccaagatcccgggcggcaacatgtacgccgacgacacggccgggtgggacacccgcatcaccgaggacgacctgcagaacgaggccaagatcaccgacatcatggagcccgagcacgccctcctggcgacgagcatcttcaagctgacctaccagaacaaggtggtgcgggtccagcgccccgccaagtccggcaccgtgatggacgtgatcagccggcgcgaccagcgggggtccggccaggtcggcacctacgggctcaacacgttcaccaacatggaggtgcagctgatccgccagatggagagcgagggcatcttctcccccagcgagctggagaactccaacctcgccgagcgggtgctggactggctggagaagcacggggtcgagcgcctcaagcggatggccatcagcggcgacgactgcgtggtgaagccgaccgacgaccgcttcgccaccgcgctgacggccctgaacgacatggggaaggtccggaaggacatcccccagtgggagccctccaagggctggaacgactggcagcaggtccccttctgcagccaccacttccaccagctcatcatgaaggacggccgcgagatcgtggtcccgtgccggaaccaggacgagctggtggggcgcgcccgggtgagccagggcgccgggtggtccctgcgcgagaccgcctgcctcggcaagagctacgcgcagatgtggcagctgatgtacttccaccggcgcgacctgcggctcgccgccaacgccatctgctccgccgtccccgtgaactgggtgcccaccagccgcaccacctggtccatccacgcgcaccaccagtggatgacgaccgaggacatgctgagcgtctggaaccgcgtgtggatcgaggagaacccctggatggaggacaagacccacgtgtccagctgggaggacgtcccgtacctggggaagcgggaggaccagtggtgcggctccctcatcggcctgaccgcccgcgccacgtgggccaccaacatccaggtggcgatcaaccaggtgcggcgcctgatcgggaacgagaactacctcgactacatgaccagcatgaagcggttcaagaacgagtccgaccccgagggcgccctgtggtga

SEQ ID NO: 7955 - RNA, 9879 nt, synthetic construct
  misc_feature 1..9879: note = derived and/or modified CDS sequence (opt1) from DENV-1__KX380798__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccctgagcatgacctgcatcgccgtggggctcgtgaccctgtacctgggcgtcatggtgcaggccgactccgggtgcgtgatcaactggaagggccgggagctcaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctggagaacatcatgtggaagcagatctccaacgagctcaaccacatcctgctggagaacgacatgaagttcaccgtcgtggtgggggacgtcgcgggcatcctcgcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctgcgggacagctacacccaggtctgcgaccaccgcctcatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctgtggagcaacggcgtcctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtggtcgacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtgaaggagaaggaggagaacctggtcaagtccatggtgagcgccggcagcggcgaggtggactccttcagcctcgggctgctgtgcatctccatcatgatcgaggaggtcatgcggagccgctggtcccggaagatgctcatgaccggcaccctggccgtgttcctgctcctgatcatggggcagctgacgtggaacgacctcatccgcctgtgcatcatggtgggcgcgaacgccagcgaccgcatggggatgggcaccacctacctggccctcatggccaccttcaagatgcggccgatgttcgccgtcgggctgctgttccgccggctcacgtcccgcgaggtgctgctgctcaccatcgggctgagcctggtggcgtccgtcgagctccccaacagcctggaggagctgggcgacgggctcgccatgggcatcatgatcctgaagctgctcaccgacttccagtcccaccagctgtgggccaccctgctcagcctgacgttcatcaagaccaccttctccctgcactacgcctggaagaccatggcgatggtgctcagcatcgtctccctgttccccctgtgcctcagcacgacctcccagaagaccacctggctgcccgtgctgctcggcagcctggggtgcaagccgctgacgatgttcctcatcgccgagaacaagatctggggccggcgctcctggcccctgaacgaggggatcatggccgtgggcatcgtcagcatcctgctcagctccctgctgaagaacgacgtgcccctcgccgggcccctgatcgccggcggcatgctgatcgcgtgctacgtgatcagcgggtccagcgccgacctctccctggagaaggccgccgaggtcagctgggaggaggaggccgagcactccggcgcgagccacaacatcctggtggaggtgcaggacgacgggaccatgaagatcaaggacgaggagcgggacgacaccctcaccatcctgctgaaggccaccctcctggccgtctccggcgtgtacccgctgagcatccccgccaccctcttcgtgtggtacttctggcagaagaagaagcagcgctccggggtcctgtgggacacccccagcccgcccgaggtggagcgggccgtgctggacgacggcatctaccgcatcatgcagcggggcctgctcgggcgctcccaggtcggcgtgggggtgttccaggagaacgtcttccacaccatgtggcacgtgacccggggcgcggtgctgatgtaccaggggaagcgcctggagcccagctgggcctccgtcaagaaggacctcatcagctacggcggcgggtggcggctgcagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgcgaggggaagatcgtgggcctctacggcaacggggtggtcaccaccagcggcacctacgtgagcgccatcgcccaggccaaggcgtcccaggaggggccgctgcccgagatcgaggacgaggtgttccggaagcgcaacctgacgatcatggacctccaccccggcagcgggaagacccggcgctacctgccggccatcgtccgggaggccatcaagcgcaagctgcgcaccctcatcctggcccccacccgggtggtggcctccgagatggcggaggccctgaagggcatgcccatccgctaccagacgaccgccgtcaagagcgagcacaccggcaaggagatcgtggacctcatgtgccacgccaccttcacgatgcggctgctgtcccccgtgcgcgtcccgaactacaacatgatcatcatggacgaggcccacttcaccgaccccagctccatcgcggcccgggggtacatcagcacccgcgtgggcatgggggaggccgccgccatcttcatgaccgcgacgccgcccggctccgtggaggccttcccgcagagcaacgccgtcatccaggacgaggagcgggacatccccgagcgctcctggaacagcgggtacgagtggatcaccgacttccccggcaagaccgtgtggttcgtgccctccatcaagagcggcaacgacatcgccaactgcctccggaagaacgggaagcgcgtcatccagctgtcccggaagaccttcgacacggagtaccagaagaccaagaacaacgactgggactacgtggtgaccaccgacatcagcgagatgggcgcgaacttccgcgccgaccgggtcatcgacccgcgccggtgcctgaagcccgtgatcctcaaggacgggcccgagcgcgtgatcctggccggccccatgccggtcacggtggcctccgccgcgcagcggcgcgggcggatcggccgcaaccacaacaaggagggcgaccagtacatctacatggggcagcccctgaacaacgacgaggaccacgcccactggaccgaggccaagatgctcctggacaacatcaacacccccgagggcatcatccccgccctgttcgagccggagcgcgagaagtccgccgcgatcgacggggagtaccggctccgcggcgaggcccggaagaccttcgtcgagctgatgcgccgcggggacctgcccgtgtggctctcctacaaggtggccagcgagggcttccagtacagcgaccgccggtggtgcttcgacggcgagcgcaacaaccaggtcctggaggagaacatggacgtggagatctggacgaaggagggggagcggaagaagctgcgcccccggtggctcgacgcccgcacctactccgaccccctggccctgcgggagttcaaggagttcgcggccggccgccggagcgtgtccggggacctcatcctggagatcggcaagctgccgcagcacctcacccagcgcgcccagaacgccctggacaacctggtcatgctccacaacagcgagcagggcgggcgggcgtaccgccacgccatggaggagctgcccgacaccatcgagacgctgatgctcctggccctgatcgccgtgctcaccggcggggtgaccctgttcttcctgtccggccgggggctcggcaagaccagcatcggcctgctgtgcgtcatggcctccagcgtgctcctgtggatggcgtccgtggagccccactggatcgccgccagcatcatcctggagttcttcctcatggtcctgctgatccccgagccggaccgccagcggacgccccaggacaaccagctcgcctacgtggtgatcgggctgctgttcatgatcctcacggtcgccgcgaacgagatgggcctgctggagaccaccaagaaggacctcgggatcggccacgtggccgtggggaaccaccaccacgccgccatgctggacgtcgacctgcaccccgcctccgcgtggaccctctacgccgtggccacgaccatcatcaccccgatgatgcgccacaccatcgagaacacgaccgccaacatcagcctgaccgccatcgcgaaccaggccgccatcctgatgggcctcgacaagggctggcccatctccaagatggacatcggggtgcccctgctggccctcggctgctacagccaggtcaaccccctgaccctgacggcggccgtgctcatgctggtggcccactacgccatcatcgggccgggcctgcaggccaaggcgacccgcgaggcccagaagcggaccgccgccgggatcatgaagaaccccaccgtcgacggcatcgtggccatcgacctcgaccccgtggtctacgacgcgaagttcgagaagcagctgggccagatcatgctgctcatcctgtgcacgtcccagatcctgctcatgcgcaccacctgggccctgtgcgagagcatcaccctggccacggggcccctcaccaccctgtgggagggctccccggggaagttctggaacaccacgatcgccgtgagcatggccaacatcttccggggctcctacctggcgggcgccgggctcgccttcagcctgatgaagtccctgggcgggggccgccgggggaccggcgcccagggcgagaccctcggggagaagtggaagcgccagctgaaccagctgtccaagagcgagttcaacacctacaagcggtccggcatcatggaggtggaccgcagcgaggcgaaggaggggctcaagcggggcgagacgaccaagcacgccgtctcccgcgggaccgccaagctgcggtggttcgtggagcgcaacctggtgaagcccgagggcaaggtcatcgacctgggctgcgggcggggcgggtggagctactactgcgccggcctcaagaaggtgaccgaggtgaaggggtacacgaagggcggccccgggcacgaggagcccatcccgatggccacctacggctggaacctggtcaagctgcactccgggaaggacgtgttcttcatcccgcccgagaagtgcgacaccctcctgtgcgacatcggcgagagctcccccaacccgaccatcgaggaggggcgcacgctgcgggtgctcaagatggtcgagccctggctgcgcggcaaccagttctgcatcaagatcctgaacccctacatgcccagcgtggtggagaccctcgagcagatgcagcggaagcacggcgggatgctggtccgcaacccgctgtcccggaacagcacccacgagatgtactgggtgtcctgcggcaccgggaacatcgtgagcgcggtcaacatgacctcccgcatgctcctgaaccgcttcacgatggcccaccggaagcccacctacgagcgcgacgtggacctgggcgccggcacccggcacgtggccgtcgagcccgaggtggccaacctcgacatcatcgggcagcgcatcgagaacatcaagcacgagcacaagagcacctggcactacgacgaggacaacccctacaagacgtgggcgtaccacggctcctacgaggtgaagccgagcgggtccgccagcagcatggtcaacggcgtggtcaagctgctgaccaagccctgggacgtgatccccatggtgacccagatcgccatgaccgacacgacccccttcgggcagcagcgggtcttcaaggagaaggtggacacccgcaccccgaaggccaagcggggcacggcccagatcatggaggtgaccgcgaagtggctctggggcttcctgtcccgcaacaagaagccccggatctgcacccgcgaggagttcacccggaaggtccgcagcaacgccgccatcggggccgtgttcgtggacgagaaccagtggaactccgcgaaggaggccgtcgaggacgagcggttctgggacctggtgcacaaggagcgcgagctccacaagcagggcaagtgcgccacgtgcgtgtacaacatgatggggaagcgggagaagaagctgggcgagttcgggaaggccaagggcagccgcgccatctggtacatgtggctgggcgcgcggttcctcgagttcgaggccctggggttcatgaacgaggaccactggttctcccgcgagaacagcctgtccggcgtcgagggggagggcctccacaagctggggtacatcctgcgggacatcagcaagatccccggcggcaacatgtacgccgacgacaccgccgggtgggacacccgcatcaccgaggacgacctccagaacgaggcccggatcacggacatcatggagccggagcacgcgctgctggccaagtccatcttcaagctcacctaccagaacaaggtggtgcgcgtccagcgccccgccaagaacggcaccgtgatggacgtgatcagccggcgcgaccagcgggggtccggccaggtcggcacctacgggctgaacacgttcaccaacatggaggcccagctgatccgccagatggagagcgagggcatcttctcccccagcgagctcgagacccccaacctggccgagcgggtgctggactggctcgagaagtacggggtggagcgcctgaagcggatggcgatctccggcgacgactgcgtcgtgaagccgatcgacgaccgcttcgccaccgccctgacggccctcaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctggtcgggcgcgcccgggtgagccagggcgcggggtggagcctccgcgagaccgcctgcctgggcaagtcctacgcccagatgtggcagctgatgtacttccaccggcgcgacctccggctggccgcgaacgccatctgcagcgccgtgcccgtcgactggatccccacctcccgcaccacgtggagcatccacgcccaccaccagtggatgaccaccgaggacatgctgtccgtgtggaaccgggtgtggatcgaggagaacccctggatggaggacaagacccacatcagctcctggggcgacgtcccgtacctcggcaagcgcgaggaccagtggtgcggcagcctgatcgggctgacggcccgcgcgacctgggccaccaacatccaggtggccatcaaccaggtgcggcgcctcatcggcaacgagaactacctggactacatgacctccatgaagcggttcaagaacgagagcgaccccgagggggccctgtggtga

SEQ ID NO: 7956 - RNA, 9879 nt, synthetic construct
  misc_feature 1..9879: note = derived and/or modified CDS sequence (opt1) from DENV-1__KJ649286__SS-prME
  source 1..9879: mol_type = other RNA
agcgtgaccatgctgctcatgctgctgcccaccgtgctcgccttccacctgaccacccgcggcggggagccccacatgatcgtgaccaagcaggagcggggcaagagcctgctgttcaagaccagcaccggggtgaacatgtgcaccctgatcgccatggacctgggcgagctctgcgaggacaccatgacctacaagtgcccccgcatcaccgaggcggagcccgacgacatcgactgctggtgcaacgccaccgacacctgggtgacctacgggacctgctcccagaccggcgagcaccggcgcgacaagcggagcgtggccctggcgccccacgtgggcctggggctcgagacccgcaccgagacgtggatgtccagcgagggcgcctggaagcagatccagcgggtcgagacctgggcgctgcgccaccccgggttcaccgtgaccgccctgttcctcgcccacgccatcggcacgtccatcacccagaaggggatcatcttcatcctgctgatgctcgtgacccccagcatggcgatgcggtgcgtcggcatcggcaaccgcgacttcgtggaggggctgtccggcgccacctgggtggacgtcgtgctggagcacgggagctgcgtgacgaccatggccaaggacaagcccaccctcgacatcgagctgctgaagaccgaggtcacgaaccccgccgtgctccggaagctgtgcatcgaggccaagatctccaacaccaccaccgacagccgctgcccgacgcagggcgaggcgaccctggtggaggagcaggacgccaacttcgtctgccggcgcaccttcgtggaccggggctgggggaacggctgcggcctgttcggcaaggggtccctgatcacgtgcgccaagttcaagtgcgtgacgaagctggagggcaagatcgtccagtacgagaacctcaagtacagcgtgatcgtgaccgtccacaccggcgaccagcaccaggtggggaacgagtccaccgagcacggcaccacggccaccatcacgccccaggcccccaccagcgagatccagctgacggactacggggcgctgaccctcgactgcagcccccggaccggcctggacttcaacgagatggtcctgctcaccatgaaggagaagtcctggctggtgcacaagcagtggttcctggacctcccgctgccctggacgtccggggccaccaccagccaggagacctggaaccggcaggacctgctcgtgacgttcaagaccgcccacgccaagaagcaggaggtcgtggtgctgggcagccaggagggcgccatgcacaccgcgctgaccggggccacggagatccagacctccggcaccaccacgatcttcgccgggcacctcaagtgccgcctgaagatggacaagctgaccctcaagggcatgagctacgtcatgtgcaccgggtccttcaagctggagaaggaggtggtggagacccagcacggcacggtcctggtccaggtgaagtacgagggcaccgacgccccctgcaagatccccttcctgacccaggacgagaagggggtcacccagaacggccgggtgatcacggccaacccgatcgtgaccgacaaggagaagcccgtcaacatcgaggcggagccgcccttcggggagagctacatcgtggtgggcgccggcgagaaggccctcaagctgtcctggttcaagaaggggagcaccatcggcaagatgttcgaggccaccgcgcgcggggcccggcgcatggccatcctgggcgacacggcctgggacttcgggtccatcggcggcgtcttcaccagcgtggggaagctcgtgcaccagatcttcggcaccgcctacggggtcctgttctccggcgtgagctggaccatgaagatcgggatcggcgtgctgctcacgtggctgggcctgaactcccgcagcacctccctcagcatgacctgcatcgcggtcgggctggtgaccctgtacctcggcgtgatggtccaggccgactccgggtgcgtgatcaactggaagggccgggagctgaagtgcgggagcggcatcttcgtgaccaacgaggtccacacgtggaccgagcagtacaagttccaggccgactccccgaagcgcctgagcgccgccatcggcaaggcgtgggaggagggggtgtgcggcatccggtccgccacccgcctcgagaacatcatgtggaagcagatcagcaacgagctgaaccacatcctgctcgagaacgacatgaagttcaccgtggtcgtgggggacgtgagcggcatcctggcccaggggaagaagatgatccggccccagcccatggagcacaagtactcctggaagtcctggggcaaggccaagatcatcggcgccgacgtccagaactccacgttcatcatcgacgggcccaacaccccggagtgccccgacgaccagcgcgcgtggaacatctgggaggtggaggactacggcttcgggatcttcaccaccaacatctggctgaagctccgggacagctacacccaggtgtgcgaccaccgcctgatgtccgccgccatcaaggacagcaaggccgtccacgcggacatgggctactggatcgagtccgagaagaacgagacctggaagctggcccgggccagcttcatcgaggtgaagacctgcgtgtggcccaagtcccacaccctctggagcaacggcgtcctggagtccgagatgatcatccccaagatctacgggggcccgatcagccagcacaactaccgccccgggtacttcacgcagaccgccggcccctggcacctggggaagctcgagctggacttcgacctgtgcgagggcaccaccgtggtggtcgacgagcactgcggcaaccgggggccgtccctccgcacgaccaccgtgaccggcaagatcatccacgagtggtgctgccggagctgcacgctgccgcccctgcgcttcaagggggaggacggctgctggtacgggatggagatccggcccgtgaaggagaaggaggagaacctcgtcaagtccatggtgagcgccggctccggcgaggtggacagcttcagcctggggctgctctgcatctccatcatgatcgaggaggtcatgcgcagccggtggtcccgcaagatgctgatgaccggcaccctggcggtgttcctcctgctgatcatggggcagctcacctggaacgacctgatccggctgtgcatcatggtcggcgccaacgccagcgaccgcatggggatgggcacgacgtacctcgccctgatggccaccttcaagatgcgcccgatgttcgccgtggggctcctcttccggcgcctgacctcccgggaggtgctgctcctgacgatcgggctgagcctcgtcgcctccgtggagctgcccaacagcctggaggagctcggcgacgggctggccatgggcatcatgatcctgaagctcctgaccgacttccagtcccaccagctgtgggccgccctcctgagcctgaccttcatcaagaccacgtgctccctccactacgcgtggaagaccatggccatggtgctgagcatcgtctccctgttccccctctgcatgagcaccacctcccagaagacgacctggctgcccgtgctgctcggcagcctggggtgcaagccgctgaccatgttcctcatcgccgagaacaagatctggggccgcaagtcctggcccctgaacgaggggatcatggccgtgggcatcgtcagcatcctgctctccagcctgctgaagaacgacgtgcccctcgcggggcccctggtggccggcggcatgctgatcgcctgctacgtcatcagcgggtccagcgccgacctctccctggagaaggccgcggaggtgagctgggaggaggaggccgagcactccggcgccagccacaacatcctggtggaggtccaggacgacgggaccatgaagatcaaggacgaggagcgggacgacaccctcacgatcctgctgaaggccaccctcctggccgtgtccggcgtgtacccgctgagcatccccgcgaccctcttcgtctggtacttctggcagaagaagaagcagcgctccggggtgctgtgggacacccccagcccgcccgaggtggagcgggccgtcctggacgacggcatctaccgcatcatgcagcggggcctgctcgggcgctcccaggtgggcgtgggggtcttccaggagaacgtgttccacacgatgtggcacgtgacccggggcgccgtcctgatgtacaaggggaagcgcctggagcccacctgggccagcgtgaagaaggacctcatctcctacggcggcgggtggcggctgcagggcagctggaacaccggggaggaggtgcaggtcatcgccgtggagcccggcaagaaccccaagaacgtgcagacggcgcccgggaccttcaagacccccgagggcgaggtcggcgccatcgccctggacttcaagcccgggacctccggcagccccatcgtgaaccgcgaggggaagatcgtgggcctctacggcaacggggtcgtgacgacctccggcacctacgtgagcgccatcgcccaggcgaaggcctcccaggaggggccgctgcccgagatcgaggacgaggtcttccggaagcgcaacctgaccatcatggacctccaccccggcagcgggaagacgcggcgctacctgccggccatcgtgcgggaggccatcaagcgcaagctgcggaccctcatcctggcgcccacccgcgtggtcgccagcgagatggccgaggccctgaagggcatgcccatccgctaccagaccacggccgtgaagtccgagcacaccggcaaggagatcgtggacctcatgtgccacgcgaccttcaccatgcggctgctgagccccgtccgcgtgccgaactacaacatgatcatcatggacgaggcccacttcacggacccctccagcatcgccgcccgggggtacatctccacccgcgtgggcatgggggaggccgcggccatcttcatgaccgccacgccgcccggcagcgtcgaggccttcccgcagtccaacgccgtgatccaggacgaggagcgggacatccccgagcgcagctggaactccgggtacgactggatcacggacttccccggcaagaccgtgtggttcgtccccagcatcaagtccggcaacgacatcgcgaactgcctccggaagaacgggaagcgcgtgatccagctgagccggaagaccttcgacaccgagtaccagaagacgaagaacaacgactgggactacgtcgtgaccaccgacatctccgagatgggcgccaacttccgcgccgaccgggtgatcgacccgcgccggtgcctgaagcccgtcatcctcaaggacgggcccgagcgcgtgatcctggccggccccatgccggtgaccgtcgcgagcgccgcccagcggcgcgggcggatcggccgcaaccagaacaaggagggcgaccagtacatctacatggggcagcccctgaacaacgacgaggaccacgcccactggacggaggccaagatgctcctggacaacatcaacacccccgagggcatcatccccgcgctgttcgagccggagcgggagaagtccgccgccatcgacggggagtaccgcctccgcggcgaggcccggaagaccttcgtggagctgatgcgccgcggggacctgcccgtgtggctcagctacaaggtcgcctccgagggcttccagtacagcgaccgccggtggtgcttcgacggcgagcgcaacaaccaggtgctggaggagaacatggacgtggagatctggaccaaggagggggagcggaagaagctgcgcccccggtggctcgacgcgcgcacgtactccgaccccctggccctgcgggagttcaaggagttcgccgccggccgccggagcgtcagcggggacctcatcctggagatcggcaagctgccgcagcacctcacccagcgcgcccagtccgcgctggacaacctggtgatgctccacaacagcgagcagggcgggcgggcctaccgccacgccatggaggagctgcccgacaccatcgagaccctgatgctcctggccctgatcgcggtgctcaccggcggggtcacgctgttcttcctgtccggcaaggggctcggcaagaccagcatcggcctgctgtgcgtgatggcctccagcatgctcctgtggatggcctccgtggagccccactggatcgccgccagcatcatcctggagttcttcctcatggtcctgctgatccccgagccggaccggcagcgcacgccccaggacaaccagctcgcgtacgtggtgatcgggctgctgttcatgatcctcaccgtcgccgccaacgagatgggcctgctggagacgaccaagaaggacctcgggatcggccacgtggccgtggagaaccaccaccacgccaccatgctggacgtcgacctgcaccccgcgtccgcctggaccctctacgccgtggccacgaccatcatcaccccgatgatgcggcacaccatcgagaacacgaccgccaacatcagcctgaccgcgatcgccaaccaggccgccatcctgatggggctcgacaagggctggcccatctccaagatggacatcggcgtgcccctgctggccctcgggtgctacagccaggtcaaccccatgaccctgacggcggccgtgctgatgctcgtggcccactacaccatcatcggcccggggctgcaggccaaggcgacccgcgaggcccagaagcggaccgccgccggcatcatgaagaaccccacggtcgacgggatcgtggccatcgacctggaccccgtggtctacgacgcgaagttcgagaagcagctcggccagatcatgctgctgatcctctgcacctcccagatcctgctgatgcgcaccacctgggccctctgcgagagcatcacgctggccaccggccccctgaccaccctctgggaggggtccccgggcaagttctggaacacgaccatcgccgtgagcatggccaacatcttccgcgggtcctacctggcgggcgccggcctggccttcagcctcatgaagtccctcgggggcgggcggcgcgggaccggggcccagggcgagaccctgggcgagaagtggaagcggcagctcaaccagctgagcaagagcgagttcaacacgtacaagcgctccgggatcatcgaggtggaccggagcgaggccaaggagggcctgaagcgcggggagaccaccaagcacgcggtctcccggggcaccgccaagctccgctggttcgtggagcggaacctggtgaagcccgaggggaaggtcatcgacctgggctgcggccgcgggggctggagctactactgcgccgggctgaagaaggtgacggaggtgaagggctacaccaagggcggggccggccacgaggagcccatccccatggcgacctacgggtggaacctcgtcaagctgcactccggcaaggacgtgttcttcatcccgcccgagaagtgcgacaccctgctctgcgacatcggggagagctcccccaaccccaccatcgaggagggccggacgctgcgcgtgctgaagatggtcgagccgtggctccgggggaaccagttctgcatcaagatcctgaacccctacatgcccagcgtggtggagaccctggagcagatgcagcgcaagcacggcggcatgctcgtccggaaccccctgtcccgcaacagcacccacgagatgtactgggtgtcctgcgggaccggcaacatcgtgagcgccgtcaacatgacgtcccggatgctgctcaaccgcttcaccatggcccaccggaagccgacctacgagcgcgacgtggacctgggggccggcacccgccacgtcgccgtggagcccgaggtggcgaacctggacatcatcggccagcggatcgagaacatcaagcacgagcacaagagcacgtggcactacgacgaggacaacccctacaagacctgggcctaccacgggtcctacgaggtcaagcccagcggctccgccagctccatggtgaacggggtggtccgcctcctgaccaagccgtgggacgtgatccccatggtgacccagatcgccatgacggacaccacccccttcggccagcagcgggtcttcaaggagaaggtggacacccgcacgcccaaggccaagcgggggaccgcccaggtgatggaggtcaccgcccgctggctgtggggcttcctcagccggaacaagaagccgcgcatctgcacccgggaggagttcacgcgcaaggtgcggagcaacgccgccatcggcgccgtgttcgtcgacgagaaccagtggaactccgcgaaggaggccgtggaggacgagcgcttctgggacctggtgcaccgggagcgcgagctgcacaagcaggggaagtgcgcgacctgcgtctacaacatgatgggcaagcgggagaagaagctcggggagttcggcaaggccaaggggagccgcgcgatctggtacatgtggctgggcgcccggttcctggagttcgaggccctcggcttcatgaacgaggaccactggttctcccgcgagaacagcctgtccggggtggagggcgaggggctgcaccggctcggctacatcctgcgcgacatcagcaagatccccgggggcaacatgtacgccgacgacaccgccggctgggacacccggatcacggaggacgacctgcagaacgaggcgaagatcaccgacatcatggagcccgagcacgccctcctggccacctccatcttcaagctgacctaccagaacaaggtggtccgcgtgcagcgcccggccaagaacgggacggtgatggacgtcatcagccggcgcgaccagcggggctccggccaggtgggcacctacggcctcaacaccttcaccaacatggaggcccagctgatccgccagatggagagcgaggggctgttctcccccagcgagctcgagacgcccaacctggcggagcgggtgctgaactggctcggcaagtacggggtcgagcgcctgaagcggatggccatctccggcgacgactgcgtggtgaagcccatcgacgaccgcttcgccaccgccctgaccgccctcaacgacatggggaaggtccggaaggacatcccgcagtgggagcccagcaagggctggaacgactggcagcaggtccccttctgctcccaccacttccaccagctgatcatgaaggacggccgcgagatcgtggtcccctgccggaaccaggacgagctggtggggcgcgcgcgggtgagccagggcgccgggtggtccctccgcgagaccgcctgcctgggcaagagctacgcccagatgtggcagctgatgtacttccaccggcgcgacctccggctggccgcgaacgccatctgcagcgccgtcccggtggactgggtgcccacgtcccgcaccacctggagcatccacgcccaccaccagtggatgaccaccgagaacatgctgtccgtctggaaccgggtgtggatcgaggagaacccctggatggaggacaagacgcacgtgagctcctgggaggacgtcccctacctcgggaagcgcgaggaccagtggtgcggcagcctgatcggcctgaccgcgcgcgccacctgggccaccaacatccaggtggccatcaaccaggtgcggaagctcatcgggaacgagaactacctggactacatgacgtccatgaagcgcttcaagaacgacagcgacccggagggcgccctgtggtga

SEQ ID NO: 7957 - RNA, 9879 nt, synthetic construct
  misc_feature 1..9879: note = derived and/or modified CDS sequence (opt1) from DENV-1__KF887994__SS-prME
  source 1..9879: mol_type = other RNA
agcgtgaccatgctgctcatgctgatgcccaccgccctggccttccacctcaccacccggggcggggagccccacatgatcgtgagcaagcaggagcggggcaagagcctgctgttcaagaccagcgcgggggtgaacatgtgcaccctcatcgccatggacctgggcgagctgtgcgaggacaccatgacctacaagtgcccccggatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgcccgacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgcccctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatcaagtacgagggcaccgacgccccctgcaagatccccttcagcacccaggacgagaagggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgctggaggccaccgcccgcggggcccggcgcatggcgatcctgggcgacacggcctgggacttcgggtccatcggcggcgtgttcaccagcgtggggaagctcgtccaccagatcttcggcaccgcctacggggtgctgttctccggcgtgagctggaccatgaagatcgggatcggcgtcctgctcacgtggctgggcctgaactcccgcagcacctccctcagcatgacctgcatcgccgtggggctggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctgtccgccgccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgtcgcgggcatcctggcccaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcgtggaacatctgggaggtggaggactacggcttcgggatcttcaccacgaacatctggctgaagctccgggacagctacacccaggtctgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcatctggcccaagtcccacacgctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtggtcgacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcaccctggccgtgttcctcctgctgatcatcgggcagctcacgtggaacgacctgatccgcctgtgcatcatggtgggcgcgaacgccagcgaccgcatggggatgggcaccacctacctcgccctgatggccaccttcaagatgcggccgatgttcgccgtcgggctcctgttccgccggctgacgtcccgcgaggtgctgctcctgaccatcgggctgagcctcatggcgtccgtggagctgcccaacagcctggaggagctcggcgacgggctggccatgggcatcatgatcctgaagctcctgaccgacttccagtcccaccagctgtgggccaccctcctgagcctgacgttcatcaagaccaccttctccctccactacgcctggaagaccatggcgatggtcctgagcatcgtgtccctgttccccctctgcctgagcacgacctcccagaagaccacctggctgcccgtcctcctgggcagcctggggtgcaagccgctcacgatgttcctgatcgccgagaacaagatctggggccggcgctcctggcccctgaacgaggggatcatggccgtgggcatcgtgagcatcctcctgagctccctgctcaagaacgacgtccccctggccgggcccctgatcgccggcggcatgctcatcgcgtgctacgtgatcagcgggtccagcgccgacctgtccctggagaaggccgccgaggtgagctgggaggaggaggccgagcactccggcgcgagccacaacatcctcgtcgaggtgcaggacgacgggaccatgaagatcaaggacgaggagcgggacgacaccctgaccatcctgctcaaggccaccctgctggccgtgtccggcgtctacccgctcagcatccccgccacgctgttcgtgtggtacttctggcagaagaagaagcagcgctccggggtgctgtgggacacccccagcccgcccgaggtcgagcgggccgtgctggacgacggcatctaccgcatcatgcagcggggcctcctggggcgctcccaggtgggcgtcggggtgttccaggagaacgtgttccacaccatgtggcacgtcacccggggcgcggtgctgatgtaccaggggaagcgcctcgagcccagctgggcctccgtgaagaaggacctgatcagctacggcggcgggtggcggctgcagggctcctggaacacgggggaggaggtccaggtgatcgccgtggagcccggcaagaaccccaagaacgtccagaccgcccccgggaccttcaagacccccgagggcgaggtgggcgccatcgcgctcgacttcaagcccgggacgagcggctcccccatcgtgaaccgcgaggggaagatcgtcggcctgtacggcaacggggtggtgaccaccagcggcacctacgtcagcgccatcgcccaggccaaggcgtcccaggaggggccgctgcccgagatcgaggacgaggtgttccggaagcgcaacctcacgatcatggacctgcaccccggcagcgggaagacccggcgctacctgccggccatcgtgcgggaggccatcaagcgcaagctccgcaccctgatcctggcccccacccgggtcgtggcctccgagatggcggaggccctcaagggcatgcccatccgctaccagacgaccgccgtcaagagcgagcacaccggcaaggagatcgtcgacctgatgtgccacgccaccttcacgatgcggctgctctcccccgtgcgcgtgccgaactacaacatgatcatcatggacgaggcccacttcaccgaccccagctccatcgcggcccgggggtacatcagcacccgcgtcggcatgggggaggccgccgccatcttcatgaccgcgacgccgcccggctccgtggaggccttcccgcagagcaacgccgtgatccaggacgaggagcgggacatccccgagcgctcctggaacagcgggtacgagtggatcaccgacttccccggcaagaccgtctggttcgtgccctccatcaagagcggcaacgacatcgccaactgcctgcggaagaacgggaagcgcgtgatccagctgtcccggaagaccttcgacacggagtaccagaagaccaagaacaacgactgggactacgtcgtgaccaccgacatcagcgagatgggcgcgaacttccgcgccgaccgggtgatcgacccgcgccggtgcctcaagcccgtcatcctgaaggacgggcccgagcgcgtgatcctggccggccccatgccggtgacggtcgcctccgccgcgcagcggcgcgggcggatcggccgcaaccacaacaaggagggcgaccagtacatctacatggggcagcccctcaacaacgacgaggaccacgcccactggaccgaggccaagatgctgctggacaacatcaacacccccgagggcatcatccccgccctcttcgagccggagcgcgagaagtccgccgcgatcgacggggagtaccggctgcgcggcgaggcccggaagaccttcgtggagctgatgcgccgcggggacctccccgtctggctgtcctacaaggtggccagcgagggcttccagtacagcgaccgccggtggtgcttcgacggcgagcgcaacaaccaggtgctggaggagaacatggacgtcgagatctggacgaaggagggggagcggaagaagctccgcccccggtggctggacgcccgcacctactccgaccccctggccctccgggagttcaaggagttcgcggccggccgccggagcgtgtccggggacctgatcctggagatcggcaagctcccgcagcacctgacccagcgcgcccagaacgccctggacaacctcgtgatgctgcacaacagcgagcagggcgggcgggcgtaccgccacgccatggaggagctgcccgacaccatcgagacgctcatgctgctggccctcatcgccgtcctgaccggcggggtgaccctgttcttcctctccggccgggggctgggcaagaccagcatcggcctgctctgcgtgatggcctccagcgtcctgctgtggatggcgtccgtggagccccactggatcgccgccagcatcatcctcgagttcttcctgatggtgctgctcatccccgagccggaccgccagcggacgccccaggacaaccagctggcctacgtcgtgatcgggctcctgttcatgatcctgacggtggccgcgaacgagatgggcctgctcgagaccaccaagaaggacctggggatcggccacgtcgccgtggggaaccaccaccacgccgccatgctggacgtggacctccaccccgcctccgcgtggaccctgtacgccgtcgccacgaccatcatcaccccgatgatgcgccacaccatcgagaacacgaccgccaacatcagcctgaccgccatcgcgaaccaggccgccatcctcatgggcctggacaagggctggcccatctccaagatggacatcggggtgcccctgctcgccctgggctgctacagccaggtgaaccccctgaccctcacggcggccgtcctgatgctggtggcccactacgccatcatcgggccgggcctccaggccaaggcgacccgcgaggcccagaagcggaccgccgccgggatcatgaagaaccccaccgtggacggcatcgtcgccatcgacctggaccccgtggtgtacgacgcgaagttcgagaagcagctgggccagatcatgctcctgatcctgtgcacgtcccagatcctcctgatgcgcaccacctgggccctgtgcgagagcatcaccctcgccacggggcccctgaccaccctgtgggagggctccccggggaagttctggaacaccacgatcgccgtcagcatggccaacatcttccggggctcctacctcgcgggcgccgggctggccttcagcctgatgaagtccctcggcgggggccgccgggggaccggcgcccagggcgagaccctgggggagaagtggaagcgccagctgaaccagctctccaagagcgagttcaacacctacaagcggtccggcatcatggaggtggaccgcagcgaggcgaaggaggggctgaagcggggcgagacgaccaagcacgccgtgtcccgcgggaccgccaagctgcggtggttcgtcgagcgcaacctggtgaagcccgagggcaaggtgatcgacctcggctgcgggcggggcgggtggagctactactgcgccggcctgaagaaggtcaccgaggtgaaggggtacacgaagggcggccccgggcacgaggagcccatcccgatggccacctacggctggaacctggtgaagctccactccgggaaggacgtcttcttcatcccgcccgagaagtgcgacaccctgctgtgcgacatcggcgagagctcccccaacccgaccatcgaggaggggcgcacgctccgggtgctgaagatggtggagccctggctgcgcggcaaccagttctgcatcaagatcctcaacccctacatgcccagcgtcgtggagaccctggagcagatgcagcggaagcacggcgggatgctggtgcgcaacccgctctcccggaacagcacccacgagatgtactgggtctcctgcggcaccgggaacatcgtgagcgcggtgaacatgacctcccgcatgctgctgaaccgcttcacgatggcccaccggaagcccacctacgagcgcgacgtcgacctcggcgccggcacccggcacgtggccgtggagcccgaggtcgccaacctggacatcatcgggcagcgcatcgagaacatcaagcacgagcacaagagcacctggtactacgacgaggacaacccctacaagacgtgggcgtaccacggctcctacgaggtgaagccgagcgggtccgccagcagcatggtgaacggcgtcgtgaagctgctcaccaagccctgggacgtcatccccatggtgacccagatcgccatgaccgacacgacccccttcgggcagcagcgggtgttcaaggagaaggtcgacacccgcaccccgaaggccaagcggggcacggcccagatcatggaggtgaccgcgaagtggctgtggggcttcctgtcccgcaacaagaagccccggatctgcacccgcgaggagttcacccggaaggtgcgcagcaacgccgccatcggggccgtcttcgtggacgagaaccagtggaactccgcgaaggaggccgtggaggacgagcggttctgggacctcgtccacaaggagcgcgagctgcacaagcagggcaagtgcgccacgtgcgtgtacaacatgatggggaagcgggagaagaagctgggcgagttcgggaaggccaagggcagccgcgccatctggtacatgtggctcggcgcgcggttcctggagttcgaggccctggggttcatgaacgaggaccactggttctcccgcgagaacagcttctccggcgtggagggggagggcctccacaagctggggtacatcctgcgggacatcagcaagatccccggcggcaacatgtacgccgacgacaccgccgggtgggacacccgcatcaccgaggacgacctccagaacgaggcccggatcacggacatcatggagccggagcacgcgctgctggccaagtccatcttcaagctcacctaccagaacaaggtcgtgcgcgtgcagcgccccgccaagaacggcaccgtcatggacgtggtgagccggcgcgaccagcgggggtccggccaggtcggcacctacgggctgaacacgttcaccaacatggaggcccagctgatccgccagatggagagcgagggcatcttctcccccagcgagctcgagacccccaacctggccgagcgggtgctggcgtggctcgagaagtacggggtggagcgcctgaagcggatggccatctccggcgacgactgcgtcgtgaagccgatcgacgaccgcttcgccaccgccctgacggccctcaacgacatggggaaggtgcggaaggacatcccccagtgggagcccagcaagggctggaacgactggcagcaggtccccttctgctcccaccacttccaccagctgatcatgaaggacggccgcgagatcgtggtgccgtgccggaaccaggacgagctggtcgggcgcgcgcgggtgagccagggcgccgggtggagcctccgcgagaccgcctgcctgggcaagtcctacgcccagatgtggcagctgatgtacttccaccggcgcgacctccggctggcggccaacgccatctgcagcgccgtgcccgtcaactggatccccacctcccgcaccacgtggagcatccacgcccaccaccagtggatgaccaccgaggacatgctgtccgtgtggaaccgggtgtggatcgaggagaacccctggatggaggacaagacccacatcagctcctggggcgacgtcccgtacctcggcaagcgcgaggaccagtggtgcggcagcctgatcgggctgacggcgcgcgccacctgggccaccaacatccaggtggccatcaaccaggtgcggaagctcatcggcaacgagaactacctggactacatgacctccatgaagcgcttcaagaacgagagcgaccccgagggggccctgtggtga

SEQ ID NO: 7958 - RNA, 9879 nt, synthetic construct
  misc_feature 1..9879: note = derived and/or modified CDS sequence (opt1) from DENV-1__JQ675358__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacaccatgacctacaagtgcccccagatcaccgaggccgagcccgacgacgtggactgctggtgcaacgccaccgacacgtgggtgacctacgggacctgcagccagaccggcgagcaccggcgggacaagcgctccgtggccctggcgccccacgtgggcctggggctcgagacgcggaccgagacctggatgagctccgagggcgcctggaagcagatccagcgcgtcgagacctgggccctgcggcaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcgatcctccgcaagctgtgcatcgaggccaagatcagcaacaccaccacggactcccggtgcccgacccagggcgaggccaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtgcacaccggcgaccagcaccaggtcgggaacgagacgaccgagcacggcaccatcgcgaccatcacgccccaggcccccacgagcgagatccagctgaccgactacggggccctcaccctggactgcagcccccggaccggcctggacttcaacgagatggtgctcctgacgatgaaggagcgcagctggctggtccacaagcagtggttcctcgacctgccgctgccctggacctccggggccagcaccagccaggagacctggaaccggcaggacctcctggtgacgttcaagaccgcccacgcgaagaagcaggaggtggtcgtgctgggctcccaggagggcgccatgcacaccgccctcaccggggccacggagatccagaccagcggcaccaccacgatcttcgccgggcacctgaagtgccgcctgaagatggacaagctcaccctgaagggcacctcctacgtgatgtgcaccgggagcttcaagctggagaaggaggtcgcggagacgcagcacggcaccgtgctggtgcaggtcaagtacgagggcaccgacgccccctgcaagatccccttctccacccaggacgagaagggggtgacgcagaacggccggctcatcaccgccaacccgatcgtgaccgacaaggagaagcccgtcaacatcgagaccgagccgcccttcggggagagctacatcgtggtgggcgccggcgagaaggcgctgaagctgtcctggttcaagaaggggagctccatcggcaagatgttcgaggccacggcccgcggggcccggcgcatggccatcctcggcgacaccgcgtgggacttcgggagcatcggcggcgtcttcacctccgtggggaagctggtgcaccaggtcttcggcaccgcctacggggtgctgttcagcggcgtgtcctggacgatgaagatcgggatcggcatcctcctgacctggctgggcctcaacagccgctccaccagcctgtccatgacctgcatcgccgtcgggatggtgacgctgtacctcggcgtgatggtccaggccgacagcgggtgcgtgatcaactggaagggccgggagctgaagtgcgggtccggcatcttcgtgaccaacgaggtccacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcacggtggtcgtgggggacgccaacggcatcctggcgcaggggaagaagatgatccggccccagcccatggagcacaagtactcctggaagtcctggggcaaggccaagatcatcggcgccgacatccagaacaccaccttcatcatcgacgggcccgacaccccggagtgccccgacaaccagcgcgcctggaacatctgggaggtggaggactacggcttcgggatcttcacgaccaacatctggctgaagctccgggactcctacacccagatgtgcgaccaccgcctgatgagcgcggccatcaaggactccaaggccgtccacgccgacatgggctactggatcgagagcgagaagaacgagacctggaagctggcccgggcgtccttcatcgaggtgaagacgtgcacctggcccaagagccacaccctctggtccaacggcgtgctggagagcgagatgatcatccccaagacctacgggggcccgatctcccagcacaactaccgccccgggtacttcacgcagaccgccggcccctggcacctggggaagctcgagctggacttcgacctgtgcgagggcaccaccgtcgtggtggacgagcactgcggcaaccgggggccgagcctccgcacgaccaccgtcaccggcaagatcatccacgagtggtgctgccggtcctgcacgctgccgcccctgcgcttccgcggggaggacggctgctggtacgggatggagatccgccccgtgaaggagaaggaggagaacctcgtgcggagcatggtctccgccggcagcggcgaggtggacagcttctccctggggatcctgtgcgccagcatcatgatcgaggaggtgatgcgctcccggtggagccgcaagatgctcatgaccggcaccctggccgtcttcctgctcctgatcatggggcagctgacctggaacgacctcatccgcctgtgcatcatggtgggcgcgaacgcctccgaccggatggggatgggcacgacctacctggccctcatggccaccttcaagatgcgcccgatgttcgccgtgggcctgctgttccggcgcctcaccagccgggaggtcctgctgctcacgatcgggctgtccctggtggcgagcgtggagctccccaactccctggaggagctgggcgacgggctcgccatgggcatcatgatgctgaagctgctcaccgagttccagccccaccagctgtggaccaccctgctcagcctgacgttcatcaagaccaccctgtccctcgactacgcctggaagaccacggccatggcgctgagcatcgtctccctgttccccctctgcctgagcaccacctcccagaagaccacctggctgccggtgctcctgggcagcttcgggtgcaagcccctgacgatgttcctcatcaccgagaacaagatctggggccgcaagtcctggcccctgaacgaggggatcatggccatcggcatcgtcagcctgctcctgtccagcctgctcaagaacgacgtgcccctggccgggccgctgatcgccggcggcatgctcatcgcctgctacgtgatcagcgggtccagcgcggacctgtccctggagaaggccgccgaggtcagctgggagcaggaggccgagcactccggcaccagccacaacatcctcgtggaggtgcaggacgacgggaccatgaagatcaaggacgaggagcgggacgacacgctgaccatcctggtcaaggccaccctcctggcggtgtccggcgtgtaccccatgagcatccccgccaccctgttcgtctggtacttctggcagaagaagaagcagcgctccggggtgctctgggacacgcccagcccgcccgaggtggagcgggccgtcctggacgacggcatctaccgcatcctgcagcggggcctgctcgggcgctcccaggtgggcgtgggggtcttccaggacggcgtgttccacaccatgtggcacgtgacccgcggggccgtcctgatgtaccagggcaagcgcctggagcccagctgggcctccgtgaagaaggacctcatcagctacggcgggggctggcggttccaggggtcctggaacaccggcgaggaggtgcaggtcatcgcggtggagccccgcaagaacccgaagaacgtgcagacgacccccgggaccttcaagacccccgagggcgaggtcggcgccatcgccctggacttcaagcccgggacgagcggctccccgatcgtgaaccgggaggggaagatcgtgggcctgtacggcaacggggtcgtgaccaccagcggcacctacgtgtccgccatcgcccaggcgaaggccagccaggaggggcccctccccgagatcgaggacgaggtcttcaagaagcgcaacctgacgatcatggacctgcacccgggcagcgggaagacccggcgctacctccccgccatcgtgcgggaggccatcaagcgcaagctgcgcaccctgatcctcgcgcccacccgggtggtcgcctccgagatggccgaggccctgaagggcatgcccatccgctaccagacgaccgccgtcaagagcgagcacaccggccgggagatcgtggacctgatgtgccacgcgaccttcacgatgcgcctcctgtccccggtccgggtgcccaactacaacatgatcatcatggacgaggcccacttcaccgaccccgccagcatcgccgcccgcgggtacatctccacccgggtgggcatgggggaggcggccgccatcttcatgaccgccacgcccccgggcagcgtcgaggccttcccccagtccaacgcggtgatccaggacgaggagcgcgacatccccgagcggagctggaactccgggtacgactggatcaccgacttccccggcaagaccgtgtggttcgtcccgagcatcaagtccggcaacgacatcgccaactgcctgcgcaagaacgggaagcgggtgatccagctcagccgcaagaccttcgacacggagtaccagaagaccaagaacaacgactgggactacgtggtcaccaccgacatctccgagatgggcgccaacttccgggccgaccgcgtgatcgacccccggcgctgcctgaagcccgtgatcctgaaggacgggcccgagcgggtcatcctcgcgggcccgatgcccgtgacggtggccagcgccgcccagcgccgggggcgcatcggccgcaaccagaacaaggagggcgaccagtacgtctacatggggcagcccctgaacaacgacgaggaccacgcccactggaccgaggcgaagatgctgctcgacaacatcaacacccccgagggcatcatcccggccctgttcgagcccgagcgggagaagtccgccgccatcgacggggagtaccgcctgcggggcgaggcccgcaagaccttcgtggagctcatgcggcgcggggacctgcccgtctggctgagctacaaggtggcgtccgagggcttccagtacagcgaccggcgctggtgcttcgacggcgagcggaacaaccaggtgctcgaggagaacatggacgtcgagatctggaccaaggagggggagcgcaagaagctgcggccccgctggctggacgcccggacgtactccgacccgctcgccctgcgcgagttcaaggagttcgccgccggccggcgcagcgtgagcggggacctgatcctcgagatcggcaagctgccccagcacctgaccctccgggcgcagaacgccctggacaacctggtgatgctccacaactccgagcagggcgggaaggcctaccgccacgccatggaggagctgcccgacaccatcgagaccctgatgctcctggcgctgatcgccgtcctcacgggcggggtgaccctgttcttcctgagcggcaaggggctcggcaagacctccatcggcctgctgtgcgtgaccgccagctccgccctcctgtggatggccagcgtcgagccccactggatcgcggcctccatcatcctggagttcttcctcatggtgctgctgatcccggagcccgaccggcagcgcacgccccaggacaaccagctcgcctacgtggtcatcgggctgctgttcatgatcctcaccgtggccgccaacgagatgggcctgctggagaccaccaagaaggacctcgggatcggccacgtggcggccgagaaccaccagcacgccacgatgctggacgtcgacctgcggccggccagcgcctggaccctctacgcggtggccaccaccgtgatcacgcccatgatgcgccacaccatcgagaacaccaccgccaacatctccctgacggccatcgccaaccaggcggccatcctgatggggctcgacaagggctggcccatcagcaagatggacatcggcgtccccctgctggccctcgggtgctactcccaggtgaacccgctgaccctgaccgccgcggtgctcatgctggtcgcccactacgccatcatcggccccgggctgcaggccaaggccacccgcgaggcgcagaagcggacggccgccggcatcatgaagaaccccaccgtggacgggatcgtggccatcgacctcgaccccgtcgtgtacgacaccaagttcgagaagcagctgggccagatcatgctgctcatcctgtgcaccagccagatcctgctcatgcgcacgacctgggccctgtgcgagtccatcaccctggcgaccggcccgctcacgaccctgtgggaggggagccccggcaagttctggaacaccaccatcgccgtgtccatggccaacatcttccgggggagctacctggccggcgccggcctcgcgttctccctgatgaagtccgtcgggggcgggcgccggggcatgggggcccagggcgagacgctgggcgagaagtggaagcgccagctcaaccagctgtccaagagcgagttcaacacctacaagcggagcgggatcatggaggtggaccgctccgaggccaaggagggcctgaagcgcggggagaccaccaagcacgccgtgagccgcggcaccgcgaagctccggtggttcgtcgagcgcaacctggtgaagcccgaggggaaggtgatcgacctgggctgcggccgcggcgggtggtcctactactgcgccgggctgaagaaggtcacggaggtgaaggggtacaccaagggcgggcccggccacgaggagccgatccccatggccacctacgggtggaacctcgtgaagctgcacagcggcaaggacgtcttcttcatgccgcccgagaagtgcgacaccctgctctgcgacatcggggagtccagcccgaaccccacgatcgaggagggccgcaccctgcgggtgctgaagatggtggagccctggctccgcgggaaccagttctgcatcaagatcctgaacccctacatgccgtccgtcgtggagaccctggagcagatgcagcggaagcacggcggcatgctcgtgcgcaaccccctgagccggaactccacccacgagatgtactgggtcagctgcgggacgggcaacatcgtgtccgccgtgaacatgaccagccgcatgctgctcaaccgcttcaccatggcccaccggaagcccacctacgagcgcgacgtcgacctgggggcgggcacgcggcacgtggccgtggagcccgaggtcgccaacctggacatcatcggccagcgcatcgagaacatcaagaacgagcacaagtccacctggcactacgacgaggacaacccgtacaagacctgggcctaccacgggagctacgaggtgaagccctccggcagcgcctccagcatggtgaacggggtcgtgcggctcctgaccaagccctgggacgtcatccccatggtgacgcagatcgcgatgaccgacaccaccccgttcggccagcagcgcgtgttcaaggagaaggtcgacacgcggacgccccgggccaagcgggggaccacccagatcatggaggtgacggccaagtggctgtggggcttcctctcccgcaacaagaagccccggatctgcacccgcgaggagttcacccggaaggtgcgcagcaacgccgccatcggcgcggtcttcgtggacgagaaccagtggaacagcgccaaggaggccgtggaggacgagcggttctgggacctggtccaccgcgagcgggagctgcacaagcaggggaagtgcgcgacctgcgtgtacaacatgatgggcaagcgcgagaagaagctcggggagttcggcaaggcgaaggggtcccgggccatctggtacatgtggctgggcgcccgcttcctggagttcgaggccctcggcttcatgaacgaggaccactggttcagccgggagaactccctgagcggggtggagggcgaggggctgcacaagctcggctacatcctgcgcgacatctccaagatccccggcgggaacatgtacgccgacgacacggcggggtgggacacccgcatcaccgaggacgacctgcagaacgaggccaagatcaccgacatcatggagcccgagcacgccctcctggccacgagcatcttcaagctgacctaccagaacaaggtcgtgcgggtgcagcgccccgccaagaacgggaccgtcatggacgtgatctcccggcgcgaccagcggggcagcggccaggtggggacctacggcctccacacgttcaccaacatggaggtccagctgatccgccagatggagtccgaggggatcttcctgcccagcgagctcgagaccccgaacctggcggagcgggtgctggactggctcgagaagcacggcgccgagcgcctgaagcggatggccatctccggggacgactgcgtggtcaagcccatcgacgaccgcttcgccaccgccctgaccgcgctcaacgacatgggcaaggtgcggaaggacatcccccagtgggagcccagcaaggggtggaacgactggcagcaggtcccgttctgctcccaccacttccaccagctgatcatgaaggacggccgcgagatcgtcgtgccctgccggaaccaggacgagctggtgggccgcgcccgggtcagccagggggccggctggtccctccgcgagacggcctgcctgggcaagagctacgcccagatgtggcagctgatgtacttccaccggcgcgacctccggctggcggccaacgccatctgctccgccgtgcccgtggactgggtccccaccagccgcaccacctggagcatccacgcgcaccaccagtggatgacgaccgaggacatgctgtccgtgtggaaccgcgtgtggatcgaggagaacccgtggatggaggacaagacccacgtcagctcctgggaggaggtgccctacctcggcaagcgggaggaccagtggtgcgggagcctgatcggcctgaccgcccgcgccacgtgggccaccaacatccaggtggccatcaaccaggtccggcgcctcatcggcaacgagaactacctggactacatgacctccatgaagcggttcaagaacgagagcgaccccgagggggcgctgtggtga

SEQ ID NO: 7959 - RNA, 9879 nt, synthetic construct
  misc_feature 1..9879: note = derived and/or modified CDS sequence (opt1) from DENV-1__FJ850070__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgtgggggtgaacatgtgcaccctgatcgccatggacctgggcgagctctgcgaggacaccatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctggcgccccacgtcggcctggggctcgagacccgcaccgagacctggatgagctccgagggcgcgtggaagcagatccagaaggtggagacctgggccctgcggcaccccgggttcacggtgatcgccctgttcctcgcccacgcgatcggcaccagcatcacccagaaggggatcatcttcatcctgctgatgctcgtcaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgcccgacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttcctcacccaggacgagaagggggtcacccagaacggccgcctgatcacggccaacccgatcgtgaccgacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcgcgccggatggccatcctgggcgacacggcctgggacttcgggtccatcggcggcctgttcaccagcgtggggaagctcatccaccaggtcttcggcaccgcgtacggggtgctgttctccggcgtgagctggaccatgaagatcgggatcggcatcctgctcacgtggctgggcctgaactcccgcagcacctccctcagcatgacctgcatcgccgtcgggatggtgaccctgtacctgggcgtgatggtccaggccgactccgggtgcgtgatcaactggaagggccgcgagctcaagtgcgggagcggcatcttcgtgacgaacgaggtccacacctggaccgagcagtacaagttccaggccgactccccgaagcggctgagcgccgcgatcggcaaggcctgggaggagggggtgtgcggcatccgcagcgccacccggctggagaacatcatgtggaagcagatctccaacgagctcaactacatcctgctggagaacgacatgaagttcaccgtggtcgtgggggacgccaacggcatcctcgcccaggggaagaagatgatccgcccccagcccatggagcacaagtacagctggaagtcctggggcaaggcgaagatcatcggcgccgacatccagaacacgaccttcatcatcgacgggcccgacaccccggagtgccccgacgaccagcgggcctggaacatctgggaggtggaggactacggcttcgggatcttcaccacgaacatctggctgaagctgcgcgacagccacacccagatgtgcgaccaccggctcatgtccgccgcgatcaaggacagcaaggccgtccacgccgacatgggctactggatcgagtccgagaagaacgagacctggaagctggcccgcgccagcttcatcgaggtgaagacctgcatctggcccaagtcccacacgctgtggagcaacggcgtgctcgagtccgagatgatcatccccaagatctacgggggcccgatcagccagcacaactaccggcccgggtacttcacccagaccgcgggcccctggcacctggggaagctggagctcgacttcgacctgtgcgagggcaccacggtcgtggtggacgagcactgcggctaccgcgggccgtccctgcggaccaccaccgtcacgggcaagatcatccacgagtggtgctgccgcagctgcaccctgccgcccctgcggttccgcggggaggacggctgctggtacgggatggagatccggcccgtgaaggagaaggaggagaacctggtgcgctccatggtcagcgccggctccggcgaggtggacagcttcagcctcgggatcctgtgcgtgtccatcctgatcgaggaggtcatgcggagccgctggtcccggaagatgctcatgaccggcaccctggccgtgttcctgctcctgatcatggggcagctgacgtggaacgacctcatccgcctgtgcatcatggtgggcgccaacgccagcgaccgcatggggatgggcaccacctacctggccctcatggccaccttcaagatgcggccgatgttcgccgtcgggctgctgttccgccggctcacgtcccgcgaggtgctgctgctcaccatcgggctgagcctggtggcctccgtcgagctccccaacagcctggaggagctgggcgacgggctcgccatgggcatcatgatgctgaagctgctcaccgacttccagccccaccagctgtggaccacgctgctctccctgaccttcatccggaccagcctgtccctcgactacgcgtggaagaccatggccatggccctgagcatcgtgtccctgttccccctctgcctgagcacgacctcccagaagaccacctggctgccggtcctcctgggcagcttcgggtgcaagcccctgacgatgttcctcatcaccgagaacaagatctggggccgcaagtcctggcccatcaacgaggggatcatggccgtgggcatcgtgagcatcctgctgtccagcctcctgaagaacgacgtccccctggcggggccgctcatcgccggcggcatgctgatcgcctgctacgtgatcagcgggtccagcgccgacctgtccctcgagaaggccgcggaggtgagctgggaggaggaggccgagcactccggcaccagccacaacatcctggtcgaggtgcaggacgacgggaccatgaagatcaaggacgaggagcgggacgacaccctgacgatcctcctgaaggccaccctgctcgccgcctccggcgtgtaccccatgagcatccccgcgaccctgttcgtctggtacttctggcagaagaagaagcagcgctccggggtgctgtgggacacccccagcccgcccgaggtggagcgggccgtcctggacgacggcatctaccgcatcctccagcggggcctgctggggcgctcccaggtgggcgtgggggtcttccaggacggcgtgttccacacgatgtggcacgtgacccgcggggccgtcctcatgtaccagggcaagcgcctggagcccagctgggcctccgtgaagaaggacctgatcagctacggcgggggctggcggttccaggggtcctggaacaccggcgaggaggtgcaggtcatcgccgtggagcccgggaagaacccgaagaacgtgcagaccacgcccggcaccttcaagacccccgagggcgaggtcggggcgatcgccctcgacttcaagcccggcaccagcgggtccccgatcgtgaaccgcgagggcaagatcgtgggcctgtacgggaacggcgtcgtgacgaccagcgggacctacgtgtccgccatcgcccaggccaaggcgagccaggagggccccctgcccgagatcgaggacgaggtcttcaagaagcggaacctcaccatcatggacctgcacccggggagcggcaagacgcgccggtacctgcccgccatcgtgcgcgaggccatcaagcggaagctccgcaccctgatcctggcccccacccgcgtggtcgcgtccgagatggccgaggccctcaagggcatgcccatccggtaccagaccacggccgtcaagagcgagcacaccgggcgcgagatcgtggacctgatgtgccacgccaccttcaccatgcggctgctctccccggtccgcgtgcccaactacaacatgatcatcatggacgaggcgcacttcacggaccccgccagcatcgccgcccggggctacatctccacccgcgtggggatgggcgaggccgcggccatcttcatgaccgccacgccgcccgggagcgtcgaggccttcccccagtccaacgccgtgatccaggacgaggagcgggacatccccgagcgcagctggaactccggctacgactggatcacggacttccccggcaagaccgtgtggttcgtccccagcatcaagtccgggaacgacatcgcgaactgcctgcggaagaacggcaagcgcgtgatccagctgagccggaagaccttcgacaccgagtaccagaagacgaagaacaacgactgggactacgtggtcaccaccgacatctccgagatgggggccaacttccgcgccgaccgggtgatcgacccccgccggtgcctcaagcccgtgatcctgaaggacggccccgagcgcgtcatcctggccgggccgatgcccgtgaccgtggcgagcgccgcccagcggcgcggccggatcggccgcaaccagaacaaggagggggaccagtacatctacatgggccagcccctcaacaacgacgaggaccacgcccactggacggaggccaagatgctgctggacaacatcaacacccccgaggggatcatcccggccctcttcgagcccgagcgcgagaagtccgccgccatcgacggcgagtaccggctgcgcggggaggcccggaagaccttcgtcgagctgatgcgccggggcgacctccccgtgtggctgagctacaaggtcgcctccgagggcttccagtacagcgaccgccggtggtgcttcgacggggagcgcaacaaccaggtgctggaggagaacatggacgtggagatctggaccaaggagggcgagcggaagaagctccgcccccggtggctggacgcgcgcacgtactccgacccgctggccctccgggagttcaaggagttcgccgccgggcgccggagcgtcagcggcgacctgatcctggagatcggcaagctcccccagcacctgaccctgcgcgcccagaacgcgctcgacaacctggtgatgctgcacaactccgagcagggcgggaaggcctaccggcacgccatggaggagctccccgacaccatcgagaccctgatgctgctcgccctgatcgcggtgctgaccgggggcgtcaccctcttcttcctgagcgggaagggcctgggcaagacctccatcgggctcctgtgcgtgatggccagctccgccctgctctggatggccagcgtggagccccactggatcgccgcgtccatcatcctggagttcttcctgatggtcctcctgatcccggagcccgaccgccagcggacgccccaggacaaccagctggcctacgtggtgatcggcctcctgttcatgatcctgaccgtcgccgccaacgagatggggctcctggagacgaccaagaaggacctgggcatcgggcacgtggccgcggagaaccaccaccacgccaccatgctcgacgtggacctgcacccggccagcgcctggaccctgtacgccgtcgcgacgaccgtgatcacccccatgatgcgccacaccatcgagaacacgaccgccaacatctccctcaccgccatcgccaaccaggccgcgatcctgatgggcctggacaagggctggcccatcagcaagatggacatcggggtgcccctcctggccctgggctgctactcccaggtcaacccgctcaccctgacggccgccgtgctgatgctcgtggcgcactacgccatcatcgggcccggcctgcaggccaaggccacccgggaggcccagaagcgcaccgcggccgggatcatgaagaaccccaccgtcgacggcatcgtgacgatcgacctggaccccgtggtctacgacgccaagttcgagaagcagctcggccagatcatgctgctgatcctctgcaccagccagatcctgctgatgcgcaccacctgggccctctgcgagtccatcacgctggccaccgggccgctgaccaccctctgggagggcagccccgggaagttctggaacacgaccatcgcggtgtccatggccaacatcttccggggcagctacctggccggcgccgggctggccttctccctcatgaagtccctgggcgggggccgccgggggaccggcgcgcagggcgagaccctgggggagaagtggaagcgccagctcaaccagctgtccaagagcgagttcaacacgtacaagaagtccggcatcatggaggtggaccggtccgaggccaaggaggggctgaagcgcggcgagaccaccaagcacgccgtcagccgggggaccgccaagctgcgctggttcgtggagcggaacctcgtgaagcccgagggcaaggtcatcgacctgggctgcgggcgcggcgggtggtcctactactgcgcgggcctgaagaaggtgacggaggtgaaggggtacaccaagggcggccccgggcacgaggagccgatccccatggccacctacggctggaacctcgtcaagctgcacagcgggaaggacgtgttcttcacgccgcccgagaagtgcgacaccctgctctgcgacatcggcgagtccagcccgaaccccacgatcgaggaggggcggaccctgcgcgtgctgaagatggtcgagccctggctccggggcaaccagttctgcatcaagatcctgaacccctacatgccgtccgtggtggagaccctggagcagatgcagcgcaagcacggcgggatgctcgtccggaaccccctgagccgcaactccacccacgagatgtactgggtgagctgcggcacggggaacatcgtgtccgccgtcaacatgaccagccggatgctgctcaaccgcttcaccatggcccaccggaagcccacctacgagcgcgacgtggacctgggcgccggcacgcgccacgtggcggtcgagcccgaggtggccaacctggacatcatcgggcagcggatcgagaacatcaagaacgagcacaagtccacctggcactacgacgaggacaacccgtacaagacctgggcctaccacggcagctacgaggtgaagtccagcgggtccgccagctccatggtcaacggcgtggtgcgcctcctgaccaagccctgggacgtcatccccatggtgacgcagatcgccatgaccgacaccacccccttcgggcagcagcgggtcttcaaggagaaggtggacacgcgcaccccgcgggcgaagcgcggcaccgcccagatcatggaggtgaccgccaagtggctgtggggcttcctcagccggaacaagaagccccgcatctgcacgcgggaggagttcacccgcaaggtccggagcaacgccgccatcggggcggtgttcgtggacgagaaccagtggaactccgccaaggaggccgtcgaggacgagcgcttctgggacctggtgcaccgggagcgcgagctgcacaagcagggcaagtgcgcgacctgcgtgtacaacatgatggggaagcgggagaagaagctcggcgagttcgggaaggcgaagggcagccgcgccatctggtacatgtggctgggcgcccggttcctggagttcgaggccctcgggttcatgaacgaggaccactggttctcccgcgagaacagcctgtccggcgtcgagggggagggcctgcacaagctcgggtacatcctgcgggacatcagcaagatccccggcggcaacatgtacgccgacgacaccgcggggtgggacacgcgcatcaccgaggacgacctgcagaacgaggccaagatcaccgacatcatggagccggagcacgccctcctggccacctccatcttcaagctgacgtaccagaacaaggtggtgcgggtccagcgccccgccaagagcggcaccgtgatggacgtgatctcccgccgggaccagcgcgggagcggccaggtcggcacctacgggctcaacaccttcacgaacatggaggtgcagctgatccggcagatggagtccgagggcatcttcagcccctccgagctggagacccccaacctcgcgaagcgcgtgctggactggctggagaagcacggggccgagcggctcaagcgcatggccatcagcggcgacgactgcgtcgtgaagccgatcgacgaccggttcgccaccgccctgaccgcgctgaacgacatggggaaggtgcgcaaggacatcccccagtgggagccctccaagggctggaacgactggcagcaggtccccttctgcagccaccacttccaccagctcatcatgaaggacggccgggagatcgtggtgccgtgccgcaaccaggacgagctggtcgggcgggcccgcgtgtcccagggcgccgggtggagcctgcgggagacggcctgcctcggcaagagctacgcccagatgtggcagctgatgtacttccaccgccgggacctgcgcctcgcggccaacgccatctgctccgccgtgcccgtcgactgggtgcccaccagccggaccacctggtccatccacgcgcaccaccagtggatgaccacggaggacatgctgagcgtgtggaaccgcgtctggatcgaggagaacccctggatggaggacaagacccacgtgtccagctgggaggaggtgccgtacctggggaagcgggaggaccagtggtgcggctccctcatcggcctgaccgcccgcgccacctgggccacgaacatccaggtcgccatcaaccaggtgcgccggctgatcgggaacgagaactacctcgactacatgaccagcatgaagcgcttcaagaacgagtccgaccccgagggcgcgctgtggtga

SEQ ID NO: 7960 - RNA, 9879 nt, synthetic construct
  misc_feature 1..9879: note = derived and/or modified CDS sequence (opt1) from DENV-1__FJ850071__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgtgggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacccgcaccgagacctggatgagctccgagggcgcgtggaagcagatccagaaggtggagacctgggccctgcggcaccccgggttcaccgtgatcgccctgttcctcgcccacgcgatcggcaccagcatcacccagaaggggatcatcttcatcctgctgatgctcgtgaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgcccgacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttcctcacccaggacgagaagggggtcacccagaacggccgcctgatcacggccaacccgatcgtgaccgacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcccgccggatggccatcctgggcgacacggcctgggacttcgggtccatcggcggcctgttcaccagcgtggggaagctcatccaccaggtcttcggcaccgcgtacggggtgctgttctccggcgtgagctggaccatgaagatcgggatcggcatcctgctcacgtggctgggcctgaactcccgcagcacctccctcagcatgacctgcatcgccgtcgggatggtgaccctgtacctgggcgtgatggtccaggccgactccgggtgcgtgatcaactggaagggccgcgagctcaagtgcgggagcggcatcttcgtgacgaacgaggtccacacctggaccgagcagtacaagttccaggccgactccccgaagcggctgagcgccgcgatcggcaaggcctgggaggagggggtgtgcggcatccgcagcgccacccggctggagaacatcatgtggaagcagatctccaacgagctcaactacatcctgctggagaacgacatgaagttcaccgtggtcgtgggggacgccaacggcatcctcgcccaggggaagaagatgatccgcccccagcccatggagcacaagtacagctggaagtcctggggcaaggcgaagatcatcggcgccgacatccagaacacgaccttcatcatcgacgggcccgacaccccggagtgccccgacgaccagcgggcctggaacatctgggaggtggaggactacggcttcgggatcttcaccacgaacatctggctgaagctgcgcgacagccacacccagatgtgcgaccaccggctcatgtccgccgcgatcaaggacagcaaggccgtccacgccgacatgggctactggatcgagtccgagaagaacgagacctggaagctggcccgcgccagcttcatcgaggtgaagacctgcatctggcccaagtcccacacgctgtggagcaacggcgtgctcgagtccgagatgatcatccccaagatctacgggggcccgatcagccagcacaactaccggcccgggtacttcacccagaccgcgggcccctggcacctggggaagctggagctcgacttcgacctgtgcgagggcaccacggtcgtggtggacgagcactgcggctaccgcgggccgtccctgcggaccaccaccgtcacgggcaagatcatccacgagtggtgctgccgcagctgcaccctgccgcccctgcggttccgcggggaggacggctgctggtacgggatggagatccggcccgtgaaggagaaggaggagaacctggtgcgctccatggtcagcgccggctccggcgaggtggacagcttcagcctcgggatcctgtgcgtgtccatcctgatcgaggaggtcatgcggagccgctggtcccggaagatgctcatgaccggcaccctggccgtgttcttcctgctcatcatggggcagctgacgtggaacgacctgatccgcctctgcatcatggtgggcgccaacgccagcgaccgcatggggatgggcaccacctacctggccctgatggccaccttcaagatgcggccgatgttcgccgtcgggctcctgttccgcaagctgacgtcccgggaggtgctcctgctgaccatcgggctcagcctggtggcctccgtcgagctgcccaacagcctcgaggagctgggcgacgggctggccatgggcatcatgatgctcaagctgctgaccgacttccagccccaccagctctggaccacgctgctgtccctcaccttcatccgcaccagcctgtccctggactacgcgtggaagaccatggccatggccctcagcatcgtgtccctgttccccctgtgcctcagcacgacctcccagaagaccacctggctgccggtcctgctcggcagcttcgggtgcaagcccctgacgatgttcctgatcaccgagaacaagatctggggccggaagtcctggcccatcaacgaggggatcatggccgtgggcatcgtgagcatcctcctgtccagcctgctcaagaacgacgtccccctggcggggccgctgatcgccggcggcatgctcatcgcctgctacgtgatcagcgggtccagcgccgacctgtccctggagaaggccgcggaggtgagctgggaggaggaggccgagcactccggcaccagccacaacatcctcgtcgaggtgcaggacgacgggaccatgaagatcaaggacgaggagcgcgacgacaccctgacgatcctgctcaaggccaccctgctggccgtgtccggcgtctaccccatgagcatccccgccaccctcttcgtgtggtacttctggcagaagaagaagcagcggtccggggtgctgtgggacacccccagcccgcccgaggtcgagcgcgcggtgctggacgacggcatctaccggatcctgcagcgcggcctcctggggcggtcccaggtgggcgtcggggtgttccaggacggcgtgttccacacgatgtggcacgtcacccgcggggccgtgctgatgtaccagggcaagcggctcgagcccagctgggcctccgtgaagaaggacctgatcagctacggcgggggctggcgcttccaggggtcctggaacaccggcgaggaggtccaggtgatcgccgtggagcccgggaagaacccgaagaacgtccagaccacgcccggcaccttcaagacccccgagggcgaggtgggggccatcgcgctggacttcaagcccggcaccagcgggtccccgatcgtgaaccgggagggcaagatcgtcggcctctacgggaacggcgtggtgacgaccagcgggacctacgtctccgccatcgcccaggccaaggccagccaggagggccccctgcccgagatcgaggacgaggtgttcaagaagcgcaacctgaccatcatggacctccacccggggagcggcaagacgcggcgctacctgcccgcgatcgtgcgggaggccatcaagcgcaagctgcggaccctcatcctggcccccacccgcgtcgtggcctccgagatggcggaggccctgaagggcatgcccatccgctaccagaccacggccgtcaagagcgagcacaccgggcgggagatcgtcgacctcatgtgccacgccaccttcaccatgcgcctgctgtccccggtgcgggtgcccaactacaacatgatcatcatggacgaggcccacttcacggaccccgcgagcatcgccgcccgcggctacatctccacccgggtcgggatgggcgaggccgccgcgatcttcatgaccgccacgccgcccgggagcgtggaggccttcccccagtccaacgccgtgatccaggacgaggagcgcgacatccccgagcggagctggaactccggctacgactggatcacggacttccccggcaagaccgtctggttcgtgcccagcatcaagtccgggaacgacatcgccaactgcctccgcaagaacggcaagcgggtgatccagctgagccgcaagaccttcgacaccgagtaccagaagacgaagaacaacgactgggactacgtcgtgaccaccgacatctccgagatgggggcgaacttccgggccgaccgcgtgatcgacccccggcgctgcctgaagcccgtcatcctcaaggacggccccgagcgggtgatcctggccgggccgatgcccgtgaccgtcgccagcgcggcccagcgccggggccgcatcggccggaaccagaacaaggagggggaccagtacatctacatgggccagcccctgaacaacgacgaggaccacgcccactggacggaggccaagatgctcctggacaacatcaacacccccgaggggatcatcccggccctgttcgagcccgagcgcgagaagtccgcggccatcgacggcgagtaccgcctccgcggggaggcccgcaagaccttcgtggagctgatgcggcgcggcgacctgcccgtctggctcagctacaaggtggcctccgagggcttccagtacagcgaccggcgctggtgcttcgacggggagcggaacaaccaggtgctggaggagaacatggacgtcgagatctggaccaaggagggcgagcgcaagaagctgcggccccgctggctcgacgcccggacgtactccgacccgctggcgctgcgcgagttcaaggagttcgccgccgggcggcgcagcgtgagcggcgacctcatcctggagatcggcaagctgccccagcacctcaccctgcgggcccagaacgccctggacaacctcgtgatgctgcacaactccgagcagggcgggaaggcgtaccgccacgccatggaggagctgcccgacaccatcgagaccctcatgctgctggccctcatcgccgtcctgaccgggggcgtgacgctgttcttcctcagcgggaagggcctgggcaagacctccatcgggctgctctgcgtgatggcgagctccgccctgctgtggatggccagcgtcgagccccactggatcgccgcctccatcatcctcgagttcttcctgatggtgctgctcatcccggagcccgaccggcagcgcacgccccaggacaaccagctggcgtacgtggtcatcggcctcctcttcatgatcctgaccgtggccgccaacgagatggggctgctcgagacgaccaagaaggacctgggcatcgggcacgtggccgccgagaaccaccaccacgcgaccatgctggacgtcgacctccggccggccagcgcctggaccctgtacgccgtggccacgaccgtgatcacccccatgatgcgccacaccatcgagaacacgaccgcgaacatctccctgaccgccatcgccaaccaggccgccatcctcatgggcctggacaagggctggcccatcagcaagatggacatcggggtccccctgctcgcgctgggctgctactcccaggtgaacccgctgaccctcacggccgccgtgctgatgctggtcgcccactacgcgatcatcgggcccggcctccaggccaaggccacccgggaggcccagaagcgcaccgccgcggggatcatgaagaaccccaccgtggacggcatcgtgacgatcgacctggaccccgtcgtgtacgacgccaagttcgagaagcagctgggccagatcatgctcctgatcctgtgcaccagccagatcctcctgatgcgcaccacctgggccctgtgcgagtccatcacgctcgccaccgggccgctgaccaccctgtgggagggcagccccgggaagttctggaacacgaccatcgccgtgtccatggcgaacatcttccggggcagctacctcgccggcgccgggctggccttctccctgatgaagtccctcggcgggggccgccgggggaccggcgcccagggcgagaccctgggggagaagtggaagcgccagctgaaccagctctccaagagcgagttcaacacgtacaagaagtccggcatcatggaggtcgaccggtccgaggcgaaggaggggctgaagcgcggcgagaccaccaagcacgccgtgagccgggggaccgccaagctgcgctggttcgtggagcggaacctggtcaagcccgagggcaaggtgatcgacctcggctgcgggcgcggcgggtggtcctactactgcgccggcctgaagaaggtgacggaggtcaaggggtacaccaagggcggccccgggcacgaggagccgatccccatggcgacctacggctggaacctggtgaagctccacagcgggaaggacgtgttcttcacgccgcccgagaagtgcgacaccctgctgtgcgacatcggcgagtccagcccgaaccccacgatcgaggaggggcggaccctccgcgtcctgaagatggtggagccctggctgcggggcaaccagttctgcatcaagatcctcaacccctacatgccgtccgtggtcgagaccctggagcagatgcagcgcaagcacggcgggatgctggtgcggaaccccctcagccgcaactccacccacgagatgtactgggtgagctgcggcacggggaacatcgtctccgccgtgaacatgaccagccggatgctgctgaaccgcttcaccatggcccaccggaagcccacctacgagcgcgacgtggacctcggcgccggcacgcgccacgtcgccgtggagcccgaggtggcgaacctggacatcatcgggcagcggatcgagaacatcaagaacgagcacaagtccacctggcactacgacgaggacaacccgtacaagacctgggcctaccacggcagctacgaggtcaagccctccgggagcgcctccagcatggtgaacggcgtggtccgcctgctcaccaagccctgggacgtgatccccatggtcacgcagatcgccatgaccgacaccaccccgttcgggcagcagcgggtgttcaaggagaaggtggacacgcgcacgccccgggccaagcgcggcaccgcgcagatcatggaggtcaccgccaagtggctgtggggcttcctgtcccggaacaagaagccccgcatctgcacgcgggaggagttcacccgcaaggtgcggagcaacgccgccatcggggccgtgttcgtcgacgagaaccagtggaacagcgcgaaggaggccgtggaggacgagcgcttctgggacctcgtgcaccgggagcgcgagctgcacaagcagggcaagtgcgcgacctgcgtctacaacatgatggggaagcgggagaagaagctgggcgagttcgggaaggccaagggctcccgcgcgatctggtacatgtggctcggcgcccggttcctggagttcgaggccctggggttcatgaacgaggaccactggttcagccgcgagaactccctcagcggcgtggagggggagggcctgcacaagctggggtacatcctccgggacatctccaagatcccgggcggcaacatgtacgccgacgacaccgccgggtgggacacgcgcatcaccgaggacgacctgcagaacgaggcgaagatcaccgacatcatggagcccgagcacgccctgctcgccaccagcatcttcaagctgacgtaccagaacaaggtggtccgggtgcagcgccccgccaagtccggcaccgtgatggacgtcatcagccgccgggaccagcgcgggtccggccaggtgggcacctacgggctgaacaccttcacgaacatggaggtgcagctcatccggcagatggagagcgagggcatcttctcccccagcgagctggagaccccgaacctggccaagcgcgtcctcgactggctggagaagcacggggcggagcggctgaagcgcatggccatctccggcgacgactgcgtggtgaagcccatcgacgaccggttcgccaccgccctcaccgccctgaacgacatggggaaggtccgcaaggacatcccccagtgggagcccagcaagggctggaacgactggcagcaggtcccgttctgctcccaccacttccaccagctgatcatgaaggacggccgggagatcgtggtcccctgccgcaaccaggacgagctcgtggggcgggcgcgcgtgagccagggcgccgggtggtccctgcgggagacggcctgcctgggcaagagctacgcccagatgtggcagctcatgtacttccaccgccgggacctgcgcctggccgcgaacgccatctgcagcgccgtccccgtggactgggtgcccacctcccggaccacctggagcatccacgcccaccaccagtggatgaccacggaggacatgctctccgtctggaaccgcgtgtggatcgaggagaacccgtggatggaggacaagacccacgtgagctcctgggaggaggtcccctacctggggaagcgggaggaccagtggtgcggcagcctgatcggcctcaccgcgcgcgccacctgggccacgaacatccaggtggccatcaaccaggtgcgccggctgatcgggaacgagaactacctggactacatgacctccatgaagcgcttcaagaacgagagcgaccccgagggcgccctctggtga

SEQ ID NO: 7961 - RNA, 9879 nt, synthetic construct
  misc_feature 1..9879: note = derived and/or modified CDS sequence (opt1) from DENV-1__FJ850073__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgccggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgggacaagcggtccgtggccctggcgccccacgtgggcctggggctcgagacgcggaccgagacctggatgagctccgagggcgcctggaagcagatccagaaggtcgagacctgggccctgcggcaccccgggttcacggtgatcgccctgttcctcgcgcacgccatcggcaccagcatcacccagaaggggatcatcttcatcctgctgatgctcgtgaccccctccatggccatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccgcaagctgtgcatcgaggccaagatcagcaacaccaccacggactcccggtgcccgacccagggcgaggccaccctggtggaggagcaggacgccaacttcgtctgccgccggaccttcgtggaccgcggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccggctgaagatggacaagctcaccctgaagggcacctcctacgtcatgtgcaccgggagcttcaagctggagaaggaggtggcggagacgcagcacggcaccgtgctggtccaggtgaagtacgagggcaccgacgccccctgcaagatccccttctccacccaggacgagaagggggtgacgcagaacggccgcctcatcaccgccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccacggcccgcggggcccgccggatggccatcctcggcgacaccgcgtgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgcgagctgaagtgcgggtccggcatcttcgtcaccaacgaggtgcacacctggaccgagcagtacaagttccaggccgacagcccgaagcggctgagcgcggccatcggccgcgcctgggaggagggggtgtgcggcatccggtccgccacccgcctcgagaacatcatgtggaagcagatcagcaacgagctgaaccacatcctgctcgagaacgacatcaagttcacggtcgtggtggggaacgccgacggcatcctggcgcaggggaagaagatgatccggccccagcccatggagcacaagtactcctggaagtcctggggcaaggccaagatcatcggcgccgacatccagaacaccaccttcatcatcgacgggcccgacaccctggagtgcccggacgagcagcgcgcctggaacatctgggaggtcgaggactacggcttcgggatcttcacgaccaacatctggctcaagctgcgggactcctacacccagatgtgcgaccaccgcctgatgagcgcggccatcaaggactccaaggccgtgcacgccgacatgggctactggatcgagagcgagaagaacgagacctggaagctcgcccgggcgtccttcatcgaggtgaagacgtgcatctggcccaagagccacaccctgtggtccaacggcgtcctggagagcgagatgatcatccccaagatgtacgggggccccgtgtcccagcacaactaccgcccggggtacttcacccagaccgccggcccctggcacctcgggaagctggagctggacttcgacctctgcgagggcacgaccgtggtcgtggacgagcactgcggcagccgggggccctccctgcgcaccaccacggtgaccggcaagatcatccacgagtggtgctgccggagctgcaccctgccgcccctccgcttccgcggggaggacggctgctggtacgggatggagatccgccccgtcaaggagaaggaggagaacctggtgcggtccatggtgagcgccggcagcggcgaggtcgactccttcagcctgggggtgctctgcgtgtccatcatgatcgaggaggtcatgcgcagccggtggtcccgcaagatgctgatgaccggcacgctggccgtgttcctcctgctgatcatggggcagctcacctggaacgacctgatccgcctgtgcatcatggtgggcgccaacgcgagcgacaagatggggatgggcaccacctacctcgccctgatggccacgttcaagatgcggcccatgttcgccgtcgggctcctgttccgccggctgacctcccgcgaggtgctgctcctgaccatcgggctgagcctcgtcgcctccgtggagctgccgaacagcctggaggagctcggcgacgggctggcgatgggcatcatgatgctgaagctcctgaccgagttccagccccaccagctgtggacgaccctcctgtccctgaccttcatcaagaccacgctcagcctggactacgcctggaagaccaccgccatggtgctgtccatcgtcagcctcttccccctgtgcctgtccaccacgagccagaagaccacctggctccccgtgctgctgggctccttcgggtgcaagccgctcaccatgttcctgatcaccgagaacgagatctggggccgcaagagctggcccctgaacgaggggatcatggccatcggcatcgtgtccatcctcctgagcagcctgctcaagaacgacgtccccctggcggggcccctgatcgccggcggcatgctcatcgcctgctacgtgatctccgggagctccgccgacctgagcctggagaaggccgcggaggtgtcctgggaggaggaggtcgagcacagcggcacgtcccacaacatcctcgtggaggtgcaggacgacgggaccatgaagatcaaggacgaggagcgcgacgacaccctgaccatcctgctcaaggccacgctgctggccgtcagcggcgtgtacccgatgtccatccccgccaccctcttcgtgtggtacttctggcagaagaagaagcagcggagcggggtcctgtgggacacccccagcccgcccgaggtggagcgcgccgtgctggacgacggcatctaccggatcctgcagcgcggcctcctggggcggagccaggtcggcgtgggggtgttccaggacggcgtcttccacaccatgtggcacgtgacgcgcggggcggtgctgatgtaccagggcaagcggctcgagccctcctgggccagcgtcaagaaggacctgatctcctacggcgggggctggcgcttccaggggagctggaacaccggcgaggaggtccaggtgatcgccgtcgagcccgggaagaaccccaagaacgtgcagaccacccccggcacgttcaagacccccgagggcgaggtgggggccatcgccctggacttcaagcccggcacctccgggagccccatcgtcaaccgggagggcaagatcgtgggcctctacgggaacggcgtggtcaccacgtccgggacctacgtgagcgcgatcgcccaggccaaggccagccaggagggcccgctgcccgagatcgaggacgaggtgttcaagaagcgcaacctgaccatcatggacctccaccccgggtccggcaagacccggcgctacctgccggccatcgtccgggaggcgatcaagcgcaagctgcggacgctcatcctggcccccacccgcgtggtggccagcgagatggccgaggcgctgaagggcatgcccatccgctaccagaccaccgccgtcaagtccgagcacacggggcgggagatcgtggacctcatgtgccacgccaccttcaccatgcgcctgctgagccccgtgcgggtcccgaactacaacatgatcatcatggacgaggcccacttcaccgaccccgcctccatcgcggcccgcggctacatcagcacgcgggtggggatgggcgaggccgccgccatcttcatgaccgcgacgccgcccgggtccgtggaggccttcccgcagagcaacgccgtcatccaggacgaggagcgcgacatccccgagcggtcctggaacagcggctacgactggatcaccgacttccccggcaagacggtgtggttcgtgccctccatcaagagcgggaacgacatcgccaactgcctccgcaagaacggcaagcgggtcatccagctgtcccgcaagaccttcgacaccgagtaccagaagaccaagaacaacgactgggactacgtggtgacgaccgacatcagcgagatgggggccaacttccgggcggaccgcgtcatcgacccgcggcgctgcctgaagcccgtgatcctcaaggacggccccgagcgggtcatcctggccgggcccatgccggtgaccgtggcctccgccgcgcagcgccggggccgcatcggccggaaccagaacaaggagggggaccagtacgtctacatgggccagcccctgaacaacgacgaggaccacgcccactggaccgaggccaagatgctcctggacaacatcaacacgcccgaggggatcatccccgccctgttcgagccggagcgcgagaagtccgccgcgatcgacggcgagtaccgcctccgcggggaggcccgcaagaccttcgtggagctgatgcggcgcggcgacctgcccgtgtggctctcctacaaggtcgccagcgagggcttccagtactccgaccggcgctggtgcttcgacggggagcggaacaaccaggtgctggaggagaacatggacgtggagatctggaccaaggagggcgagcgcaagaagctgcggccccgctggctcgacgcccggacctacagcgaccccctggccctgcgcgagttcaaggagttcgcggccgggcggcgcagcgtctccggcgacctcatcctggagatcggcaagctgccgcagcacctcaccctgcgggcccagaacgccctggacaacctcgtgatgctgcacaacagcgagcagggcgggaaggcctaccgccacgcgatggaggagctgcccgacacgatcgagaccctcatgctgctggccctcatggccgtgctgaccgggggcgtcaccctgttcttcctctccgggaagggcctgggcaagacgagcatcgggctgctctgcgtgatggcctccagcgcgctgctgtggatggcctccgtggagccccactggatcgccgccagcatcatcctcgagttcttcctgatggtcctgctcatccccgagccggaccggcagcgcacgccccaggacaaccagctggcctacgtggtgatcggcctcctcttcatgatcctgaccgtcgcggccaacgagatggggctgctcgagaccacgaagaaggacctgggcatcgggcacgtggccgccgagaaccaccagcacgccaccatgctggacgtggacctccaccccgcgtccgcctggaccctgtacgccgtcgccaccacggtgatcaccccgatgatgcggcacaccatcgagaacaccacggccaacatcagcctgaccgcgatcgccaaccaggccgccatcctcatgggcctggacaagggctggcccatctccaagatggacctgggggtgcccctcctggccctgggctgctacagccaggtcaaccccctcaccctgaccgcggccgtgctgatgctcgtggcccactacgccatcatcgggccgggcctgcaggcgaaggccacgcgcgaggcccagaagcggaccgccgccgggatcatgaagaaccccaccgtcgacggcatcgtggcgatcgacctggaccccgtggtctacgacgccaagttcgagaagcagctcggccagatcatgctgctgatcctctgcacctcccagatcctgctgatgcgcacgacctgggccctctgcgagagcatcaccctggccaccgggcccctgacgaccctctgggagggctccccggggaagttctggaacaccaccatcgccgtgagcatggcgaacatcttccgcggctcctacctggccggcgccgggctggccttcagcctcatgaagtccctgggcgggggccggcgcgggacgggcgcccagggcgagaccctgggggagaagtggaagcggcagctcaaccagctgagcaagagcgagttcaacacctacaagcgctccggcatcatggaggtggaccggagcgaggcgaaggaggggctgaagcgcggcgagaccacgaagcacgccgtctcccgggggaccgccaagctgcgctggttcgtggagcggaacctcgtgaagcccgagggcaaggtcatcgacctgggctgcgggcgcggcgggtggagctactactgcgccggcctgaagaaggtgaccgaggtgaaggggtacaccaagggcggccccgggcacgaggagcccatcccgatggcgacctacggctggaacctcgtcaagctgcactccgggaaggacgtgttcttcatgccgcccgagaagtgcgacacgctgctctgcgacatcggcgagagctcccccaacccgaccatcgaggaggggcggaccctgcgcgtgctgaagatggtcgagccctggctccggggcaaccagttctgcatcaagatcctgaacccctacatgcccagcgtggtggagaccctggagcagatgcagcgcaagcacggcgggatgctcgtccggaacccgctgtcccgcaacagcacgcacgagatgtactgggtgtcctgcggcaccgggaacatcgtgagcgccgtcaacatgacctcccggatgctgctcaaccgcttcaccatggcccaccggaagcccacgtacgagcgcgacgtggacctgggcgccggcacccgccacgtggccgtcgagcccgaggtggcgaacctggacatcatcgggcagcggatcgagaacatcaagaacgagcacaagagcacctggcactacgacgaggacaacccctacaagacctgggcctaccacggctcctacgaggtcaagccgagcgggtccgccagctccatggtgaacggcgtggtccgcctcctgacgaagccctgggacgtgatccccatggtgacccagatcgccatgaccgacaccacgcccttcgggcagcagcgggtcttcaaggagaaggtggacacccgcaccccgcgggccaagcgcggcaccgcgcagatcatggaggtgacggccaagtggctgtggggcttcctcagccggaacaagaagccccgcatctgcacccgggaggagttcacccgcaaggtccggagcaacgccgccatcggggccgtgttcgtggacgagaaccagtggaactccgcgaaggaggccgtcgaggacgagcgcttctgggacctggtgcaccgggagcgcgagctgcacaagcagggcaagtgcgcgacctgcgtgtacaacatgatggggaagcgggagaagaagctcggcgagttcgggaaggccaagggcagccgcgcgatctggtacatgtggctgggcgcccggttcctggagttcgaggccctcgggttcatgaacgaggaccactggttctcccgcgagaacagcctgtccggcgtcgagggggagggcctgcacaagctcgggtacatcctgcgggacatcagcaagatccccggcggcaacatgtacgccgacgacacggccgggtgggacacccgcatcaccgaggacgacctgcggaacgaggcgaagatcaccgacatcatggagccggagcacgccctcctggccacgtccatcttcaagctgacctaccagaacaaggtggtgcgcgtccagcgccccgccaagaacggcaccgtgatggacgtgatcagccggcgcgaccagcgggggtccggccaggtcggcacctacgggctcaacacgttcaccaacatggaggtgcagctgatccgccagatggagagcgagggcatcttcttctccagcgagctggagtcccccaacctcgccgagcgggtgctggactggctggagaagcacggggcggagcgcctcaagcggatggccatcagcggcgacgactgcgtcgtgaagcccatcgacgaccgcttcgccaccgccctgatcgccctgaacgacatggggaaggtgcggaaggacatcccgcagtgggagccctccaagggctggaacgactggcagcaggtccccttctgcagccaccacttccaccagctcatcatgaaggacggccgcgagatcgtggtgccctgccggaaccaggacgagctggtcgggcgcgcgcgggtgtcccagggcgccgggtggagcctgcgcgagaccgcctgcctcggcaagagctacgcccagatgtggcagctgatgtacttccaccggcgcgacctgcggctcgccgcgaacgccatctgctccgccgtgccggtcgactgggtgcccacgagccgcaccacctggtccatccacgcccaccaccagtggatgaccaccgaggacatgctgagcgtgtggaaccgggtctggatcgaggagaacccctggatggaggacaagacgcacgtgtccagctgggaggaggtgccctacctggggaagcgcgaggaccagtggtgcggctccctcatcggcctgaccgcgcgcgccacctgggccaccaacatccaggtcgccatcaaccaggtgcggcgcctgatcgggaacggcaactacctcgactacatgacgagcatgaagcggttcaagaacgagtccgacccggagggggccctgtggtga

SEQ ID NO: 7962 - RNA, 9879 nt, synthetic construct
  misc_feature 1..9879: note = derived and/or modified CDS sequence (opt1) from DENV-1__FJ850075__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgtgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacgcgcaccgagacctggatgagctccgagggcgcctggaagcagatccagaaggtggagacctgggccctgcggcaccccgggttcacggtgatcgccctgttcctcgcccacgcgatcggcaccagcatcacccagaaggggatcatcttcatcctgctgatgctcgtgaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgccccacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttcctcacccaggacgagaagggggtcacccagaacggccgcctgatcacggccaacccgatcgtgaccgacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcccgccggatggccatcctgggcgacacggcctgggacttcgggtccatcggcggcctgttcaccagcgtggggaagctcatccaccaggtcttcggcaccgcgtacggggtgctgttctccggcgtgagctggaccatgaagatcgggatcggcatcctgctcacgtggctgggcctgaactcccgcagcacctccctcagcatgacctgcatcgccgtcgggatggtgaccctgtacctgggcgtgatggtccaggccgactccgggtgcgtgatcaactggaagggccgcgagctcaagtgcgggagcggcatcttcgtgacgaacgaggtccacacctggaccgagcagtacaagttccaggccgactccccgaagcggctgagcgccgcgatcggcaaggcctgggaggagggggtgtgcggcatccgcagcgccacccggctggagaacatcatgtggaagcagatctccaacgagctcaactacatcctgctggagaacgacatgaagttcaccgtggtcgtgggggacgccaacggcatcctcgcccaggggaagaagatgatccgcccccagcccatggagcacaagtacagctggaagtcctggggcaaggcgaagatcatcggcgccgacatccagaacacgaccttcatcatcgacgggcccgacaccccggagtgccccgacgaccagcgggcctggaacatctgggaggtggaggactacggcttcgggatcttcaccacgaacatctggctgaagctgcgcgacagccacacccagatgtgcgaccaccggctcatgtccgccgcgatcaaggacagcaaggccgtccacgccgacatgggctactggatcgagtccgagaagaacgagacctggaagctggcccgcgccagcttcatcgaggtgaagacctgcatctggcccaagtcccacacgctgtggagcaacggcgtgctcgagtccgagatgatcatccccaagatctacgggggcccgatcagccagcacaactaccggcccgggtacttcacccagaccgcgggcccctggcacctggggaagctggagctcgacttcgacctgtgcgagggcaccacggtcgtggtggacgagcactgcggctaccgcgggccgtccctgcggaccaccaccgtcacgggcaagaccatccacgagtggtgctgccgcagctgcaccctgccgcccctgcggttccgcggggaggacggctgctggtacgggatggagatccggcccgtgaaggagaaggaggagaacctggtgcgctccatggtcagcgccggctccggcgaggtggacagcttcagcctcgggatcctgtgcgtgtccatcctgatcgaggaggtcatgcggagccgctggtcccggaagatgctcatgaccggcacgctggccgtgttcctgctcctgatcatggggcagctgacctggaacgacctcatccgcctgtgcatcatggtgggcgccaacgccagcgaccgcatggggatgggcaccacctacctggcgctcatggccacgttcaagatgcggccgatgttcgccgtcggcctgctgttccgccggctcacctcccgcgaggtgctgctgctcaccatcgggctgagcctggtggcctccgtcgagctccccaacagcctggaggagctgggcgacgggctcgccatgggcatcatgatgctgaagctgctcaccgacttccagccccaccagctgtggacgaccctgctctccctgaccttcatccggaccagcctgtccctcgactacgcgtggaagacgatggccatggccctgagcatcgtgtccctgttccccctctgcctgagcaccacctcccagaagaccacgtggctgccggtcctcctgggcagcttcgggtgcaagcccctgaccatgttcctcatcaccgagaacaagatctggggccgcaagtcctggcccatcaacgaggggatcatggccgtgggcatcgtgagcatcctgctgtccagcctcctgaagaacgacgtccccctggcggggccgctcatcgccggcggcatgctgatcgcctgctacgtgatcagcgggtccagcgccgacctgtccctcgagaaggccgcggaggtgagctgggaggaggaggccgagcactccggcaccagccacaacatcctggtcgaggtgcaggacgacgggaccatgaagatcaaggacgaggagcgggacgacacgctgaccatcctcctgaaggccaccctgctcgccgtgtccggcgtctaccccatgagcatccccgccaccctgttcgtgtggtacttctggcagaagaagaagcagcgctccggggtgctgtgggacacgcccagcccgcccgaggtcgagcgggcggtgctggacgacggcatctaccgcatcctccagcggggcctgctggggcgctcccaggtgggcgtcggggtgttccaggacggcgtgttccacaccatgtggcacgtcacccgcggggccgtgctcatgtaccagggcaagcgcctggagcccagctgggcctccgtgaagaaggacctgatcagctacggcgggggctggcggttccaggggtcctggaacaccggcgaggaggtccaggtgatcgccgtggagcccgggaagaacccgaagaacgtccagacgacccccggcaccttcaagacccccgagggcgaggtgggggccatcgcgctcgacttcaagcccggcacgagcgggtccccgatcgtgaaccgcgagggcaagatcgtcggcctgtacgggaacggcgtggtgaccaccagcgggacctacgtctccgccatcgcccaggccaaggccagccaggagggccccctgcccgagatcgaggacgaggtgttcaagaagcggaacctcacgatcatggacctgcacccggggagcggcaagacccgccggtacctgcccgcgatcgtgcgcgaggccatcaagcggaagctccgcaccctgatcctggcccccacccgcgtcgtggcctccgagatggcggaggccctcaagggcatgcccatccggtaccagacgaccgccgtcaagagcgagcacaccgggcgcgagatcgtcgacctgatgtgccacgccaccttcacgatgcggctgctctccccggtgcgcgtgcccaactacaacatgatcatcatggacgaggcccacttcaccgaccccgcgagcatcgccgcccggggctacatctccacccgcgtcgggatgggcgaggccgccgcgatcttcatgaccgccacgcccccggggagcgtggaggccttcccccagtccaacgccgtgatccaggacgaggagcgggacatccccgagcgcagctggaactccggctacgactggatcaccgacttccccggcaagaccgtctggttcgtgccgagcatcaagtccgggaacgacatcgccaactgcctgcggaagaacggcaagcgcgtgatccagctgagccggaagaccttcgacacggagtaccagaagaccaagaacaacgactgggactacgtcgtgaccaccgacatctccgagatgggggcgaacttccgcgccgaccgggtgatcgacccccgccggtgcctcaagcccgtcatcctgaaggacggccccgagcgcgtgatcctggccgggccgatgcccgtgacggtcgccagcgcggcccagcggcgcggccggatcggccgcaaccagaacaaggagggggaccagtacatctacatgggccagcccctcaacaacgacgaggaccacgcccactggaccgaggccaagatgctgctggacaacatcaacacccccgaggggatcatcccggccctcttcgagcccgagcgcgagaagtccgcggccatcgacggcgagtaccggctgcgcggggaggcccggaagaccttcgtggagctgatgcgccggggcgacctccccgtctggctgagctacaaggtggcctccgagggcttccagtacagcgaccgccggtggtgcttcgacggggagcgcaacaaccaggtgctggaggagaacatggacgtcgagatctggacgaaggagggcgagcggaagaagctccgcccccggtggctggacgcccgcacctactccgacccgctggcgctccgggagttcaaggagttcgccgccgggcgccggagcgtgagcggcgacctgatcctggagatcggcaagctcccccagcacctgaccctgcgcgcccagaacgccctcgacaacctggtgatgctgcacaactccgagcagggcgggaaggcgtaccggcacgccatggaggagctccccgacaccatcgagaccctgatgctgctcgccctgatcgccgtcctgaccggcggggtgaccctcttcttcctgagcgggaaggggctgggcaagacctccatcgggctcctgtgcgtgatggcgagctccgccctgctctggatggccagcgtcgagccccactggatcgccgcctccatcatcctggagttcttcctgatggtgctcctgatcccggagcccgaccgccagcggacgccccaggacaaccagctggcgtacgtggtcatcggcctcctgttcatgatcctgacggtggccgccaacgagatggggctcctggagaccaccaagaaggacctgggcatcgggcacgtggccgccgagaaccaccaccacgcgaccatgctcgacgtcgacctgcgcccggccagcgcctggacgctgtacgccgtggccaccaccgtgatcacccccatgatgcggcacacgatcgagaacaccaccgcgaacatctccctcaccgccatcgccaaccaggccgccatcctgatgggcctggacaagggctggcccatcagcaagatggacatcggggtccccctcctggcgctgggctgctactcccaggtgaacccgctcacgctgaccgccgccgtgctgatgctcgtcgcccactacgcgatcatcgggcccggcctgcaggccaaggccacccgcgaggcccagaagcgcaccgccgcggggatcatgaagaaccccacggtggacggcatcgtgaccatcgacctggaccccgtcgtgtacgacgccaagttcgagaagcagctcggccagatcatgctgctgatcctctgcaccagccagatcctgctgatgcggaccacgtgggccctctgcgagtccatcaccctggccaccgggccgctgaccacgctctgggagggcagccccgggaagttctggaacaccaccatcgccgtgtccatggcgaacatcttccgcggcagctacctggccggcgccgggctggccttctccctcatgaagtccctgggcgggggccggcgcgggaccggcgcccagggcgagacgctgggggagaagtggaagcggcagctcaaccagctgtccaagagcgagttcaacacctacaagaagtccggcatcatggaggtcgaccgctccgaggcgaaggaggggctgaagcggggcgagaccaccaagcacgccgtgagccgcgggacggccaagctgcggtggttcgtggagcgcaacctcgtcaagcccgagggcaaggtgatcgacctgggctgcgggcggggcgggtggtcctactactgcgccggcctgaagaaggtgaccgaggtcaaggggtacaccaagggcggccccgggcacgaggagccgatccccatggcgacctacggctggaacctcgtgaagctgcacagcgggaaggacgtgttcttcacgccgcccgagaagtgcgacacgctgctctgcgacatcggcgagtccagcccgaaccccaccatcgaggaggggcgcaccctgcgggtcctgaagatggtggagccctggctccgcggcaaccagttctgcatcaagatcctgaacccctacatgccgtccgtggtcgagaccctggagcagatgcagcggaagcacggcgggatgctcgtgcgcaaccccctgagccggaactccacgcacgagatgtactgggtgagctgcggcaccgggaacatcgtctccgccgtgaacatgaccagccgcatgctgctcaaccggttcaccatggcccaccgcaagcccacgtacgagcgcgacgtggacctgggcgccggcacccggcacgtcgccgtggagcccgaggtggcgaacctggacatcatcgggcagcgcatcgagaacatcaagaacgagcacaagtccacctggcactacgacgaggacaacccgtacaagacctgggcctaccacggcagctacgaggtcaagccctccgggagcgcctccagcatggtgaacggcgtggtccggctcctgacgaagccctgggacgtgatccccatggtcacccagatcgccatgaccgacaccacgccgttcgggcagcagcgcgtgttcaaggagaaggtggacacccggacgccccgggccaagcggggcaccgcgcagatcatggaggtcacggccaagtggctgtggggcttcctctcccgcaacaagaagccccggatctgcacccgcgaggagttcacccggaaggtgcgcagcaacgccgccatcggggccgtgttcgtcgacgagaaccagtggaacagcgcgaaggaggccgtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggctcccgggcgatctggtacatgtggctgggcgcccgcttcctggagttcgaggccctcgggttcatgaacgaggaccactggttcagccgggagaactccctgagcggcgtggagggggagggcctgcacaagctcgggtacatcctgcgcgacatctccaagatcccgggcggcaacatgtacgccgacgacacggccgggtgggacacccggatcaccgaggacgacctgcagaacgaggcgaagatcaccgacatcatggagcccgagcacgccctcctggccacgagcatcttcaagctgacctaccagaacaaggtggtccgcgtgcagcgccccgccaagtccggcaccgtgatggacgtcatcagccggcgcgaccagcgggggtccggccaggtgggcacctacgggctcaacacgttcaccaacatggaggtgcagctgatccgccagatggagagcgagggcatcttctcccccagcgagctggagaccccgaacctcgccaagcgggtcctggactggctggagaagcacggggtggagcgcctcaagcggatggcgatctccggcgacgactgcgtggtcaagcccatcgacgaccgcttcgccaccgccctgacggccctgaacgacatggggaaggtgcggaaggacatcccccagtgggagcccagcaagggctggaacgactggcagcaggtcccgttctgctcccaccacttccaccagctcatcatgaaggacggccgcgagatcgtcgtgccctgccggaaccaggacgagctggtggggcgcgcccgggtcagccagggcgcggggtggtccctgcgcgagaccgcctgcctcggcaagagctacgcccagatgtggcagctgatgtacttccaccggcgcgacctgcggctcgccgccaacgcgatctgcagcgccgtgcccgtggactgggtccccacctcccgcaccacctggagcatccacgcccaccaccagtggatgacgaccgaggacatgctgtccgtgtggaaccgggtgtggatcgaggagaacccgtggatggaggacaagacccacgtcagctcctgggaggaggtgccctacctggggaagcgcgaggaccagtggtgcggcagcctcatcggcctgaccgcccgcgcgacgtgggccaccaacatccaggtggccatcaaccaggtccggcgcctgatcgggaacgagaactacctcgactacatgacctccatgaagcggttcaagaacgagagcgaccccgagggcgccctgtggtga

SEQ ID NO: 7963 - RNA, 9879 nt, synthetic construct
  misc_feature 1..9879: note = derived and/or modified CDS sequence (opt1) from DENV-1__FJ850077__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgtgggggtgaacatgtgcaccctgatcgccatggacctgggcgagctctgcgaggacaccatgacctacaagtgcccccggatcaccgaggtggagcccgacgacgtggactgctggtgcaacgccaccgacacgtgggtgacctacgggacctgcagccagaccggcgagcaccggcgcgacaagcggtccgtcgccctggcgccccacgtgggcctggggctcgagacccgcaccgagacctggatgagctccgagggcgcctggaagcaggtccagaaggtggagacctgggcgctgcggcaccccgggttcacggtgatcgccctgttcctcgcccacgccatcggcaccagcatcacccagaaggggatcatcttcatcctgctgatgctcgtgaccccctccatggcgatgcgctgcgtcggcatcggcaaccgggacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgccgtgctccgcaagctgtgcatcgaggccaagatcagcaacaccaccacggactcccggtgcccgacccagggcgaggcgaccctggtggaggagcaggacgccaacttcgtctgccgccggaccttcgtggaccgcggctgggggaacggctgcggcctcttcggcaaggggagcctgctgacgtgcgccaagttcaagtgcgtgaccaagctcgagggcaagatcgtccagtacgagaacctgaagtactccgtgatcgtcaccgtgcacaccggcgaccagcaccaggtggggaacgagacgaccgagcacggcaccatcgccaccatcacgccccaggcccccacgagcgagatccagctgaccgactacggggcgctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccacgccaagaagcaggaggtcgtggtgctgggctcccaggagggcgccatgcacaccgcgctcaccggggccacggagatccagaccagcggcaccaccacgatcttcgccgggcacctgaagtgccggctgaagatggacaagctcaccctgaagggcatgtcctacgtcatgtgcaccgggagcttcaagctggagaaggaggtggccgagacccagcacggcacggtgctggtccaggtgaagtacgagggcaccgacgccccctgcaagatccccttcctcacccaggacgagaagggggtgacccagaacggccgcctgatcacggcgaacccgatcgtcaccgacaaggagaagcccgtgaacatcgagaccgagccgcccttcggggagtcctacatcgtggtcggcgccggcgagaaggccctgaagctcagctggttcaagaaggggtccagcatcggcaagatgttcgaggccaccgcgcgcggggcccgccggatggccatcctgggcgacacggcctgggacttcgggtccatcggcggcctgttcaccagcgtggggaagctcatccaccaggtgttcggcaccgcctacggggtcctgttctccggcgtgagctggaccatgaagatcgggatcggcatcctgctcacgtggctgggcctgaactcccgcagcacctccctcagcatgacctgcatcgcggtggggatggtcaccctgtacctgggcgtgatggtgcaggccgactccgggtgcgtcatcaactggaagggccgcgagctcaagtgcgggagcggcatcttcgtgacgaacgaggtgcacacctggaccgagcagtacaagttccaggccgactccccgaagcggctgagcgccgccatcggcaaggcgtgggaggagggggtctgcggcatccgcagcgccacccggctggagaacatcatgtggaagcagatctccaacgagctcaactacatcctgctggagaacgacatgaagttcaccgtggtggtcggggacgccaacggcatcctcacgcaggggaagaagatgatccgcccccagcccatggagcacaagtacagctggaagtcctggggcaaggccaagatcatcggcgccgacatccagaacaccaccttcatcatcgacgggcccgacaccccggagtgccccgacgaccagcgggcgtggaacatctgggaggtggaggactacggcttcgggatcttcacgaccaacatctggctgaagctgcgcgacagctacacccagatgtgcgaccaccggctcatgtccgccgccatcaaggacagcaaggccgtgcacgcggacatgggctactggatcgagtccgagaagaacgagacctggaagctggcccgcgccagcttcatcgaggtcaagacgtgcatctggcccaagtcccacaccctgtggagcaacggcgtgctcgagtccgagatgatcatccccaagatctacgggggcccgaccagccagcacaactaccggcccgggtacttcacccagacggccggcccctggcacctggggaagctggagctcgacttcgacctgtgcgagggcaccaccgtggtcgtggacgagcactgcggctaccgcgggccgtccctgcggaccacgaccgtgaccggcaagatcatccacgagtggtgctgccgcagctgcaccctgccgcccctgcggttccgcggggaggacggctgctggtacgggatggagatccggcccgtcaaggagaaggaggagaacctggtgcgctccatggtgagcgccggctccggcgaggtcgacagcttcagcctcgggatcctgtgcgtgtccatcctgatcgaggaggtgatgcggagccgctggtcccggaagatgctcatgacgggcaccctggcggtcttcctgctcctgatcatggggcagctgacctggaacgacctcatccgcctgtgcatcatggtgggcgccaacgccagcgaccgcatggggatgggcaccacgtacctggccctcatggccaccttcaagatgcggccgatgttcgccgtggggctgctgttccgcaagctcacctcccgggaggtcctgctgctcaccatcgggctgagcctggtggcctccgtcgagctccccaacagcctggaggagctgggcgacgggctcgccatgggcatcatgatgctgaagctgctcacggacttccagccccaccagctgtggaccaccctgctctccctgaccttcatccgcacgagcctgtccctcgactacgcctggaagaccatggccatggcgctgagcatcgtgtccctgttccccctctgcctgagcaccacctcccagaagacgacctggctgccggtgctcctgggcagcttcgggtgcaagcccctgaccatgttcctcatcaccgagaaccggatctggggccgcaagtcctggcccatcaacgagggggtcatggccgtgggcatcgtgagcatcctgctgtccagcctcctgaagaacgacgtccccctggccgggccgctcatcgccggcggcatgctgatcgcgtgctacgtgatcagcgggtccagcgccgacctgtccctcgagaaggccgccgaggtgagctgggaggaggaggccgagcactccggcaccagccacaacatcctggtcgaggtgcaggacgacgggacgatgaagatcaaggacgaggagcgggacgacaccctgaccatcctcctgaaggcgaccctgctcgccgtgtccggcgtctaccccatgagcatccccgccacgctgttcgtgtggtacttctggcagaagaagaagcagcgctccggggtgctgtgggacacccccagcccgcccgaggtcgagcgggccgtgctggacgacggcatctaccgcatcctccagcggggcctgctggggcgctcccaggtgggcgtcggggtgttccaggacggcgtgttccacaccatgtggcacgtcacccgcggggccgtgctcatgtaccagggcaagcgcctggagcccagctgggcgtccgtgaagaaggacctgatcagctacggcgggggctggcggttccaggggtcctggaacacgggcgaggaggtccaggtgatcgccgtggagcccgggaagaacccgaagaacgtccagaccacccccggcaccttcaagacgcccgagggcgaggtgggggccatcgccctcgacttcaagcccggcaccagcgggtccccgatcgtgaaccgcgagggcaagatcgtcggcctgtacgggaacggcgtggtgaccaccagcgggacgtacgtctccgccatcgcgcaggccaaggccagccaggagggccccctgcccgagatcgaggacgaggtgttcaagaagcggaacctcaccatcatggacctgcacccggggagcggcaagacccgccggtacctgcccgccatcgtgcgcgaggccatcaagcggaagctccgcaccctgatcctggcgcccacgcgcgtcgtggcctccgagatggccgaggccctcaagggcatgcccatccggtaccagaccaccgcggtcaagagcgagcacaccgggcgcgagatcgtcgacctgatgtgccacgccacgttcaccatgcggctgctctccccggtgcgcgtgcccaactacaacatgatcatcatggacgaggcccacttcaccgaccccgccagcatcgccgcgcggggctacatctccacccgcgtcgggatgggcgaggccgccgccatcttcatgacggccacgccgcccgggagcgtggaggcgttcccccagtccaacgccgtgatccaggacgaggagcgggacatccccgagcgcagctggaactccggctacgactggatcaccgacttccccggcaagaccgtctggttcgtgcccagcatcaagtccgggaacgacatcgccaactgcctgcggaagaacggcaagcgcgtgatccagctgagccggaagacgttcgacaccgagtaccagaagaccaagaacaacgactgggactacgtcgtgaccacggacatctccgagatgggggccaacttccgcgccgaccgggtgatcgacccccgccggtgcctcaagcccgtcatcctgaaggacggccccgagcgcgtgatcctggcggggccgatgcccgtcaccgtggccagcgccgcccagcggcgcggccggatcggccgcaaccagaacaaggagggggaccagtacatctacatgggccagcccctcaacaacgacgaggaccacgcgcactggaccgaggccaagatgctgctggacaacatcaacacccccgaggggatcatcccggccctcttcgagcccgagcgcgagaagtccgccgccatcgacggcgagtaccggctgcgcggggaggcgcggaagacgttcgtggagctgatgcgccggggcgacctccccgtctggctgagctacaaggtggcctccgagggcttccagtacagcgaccgccggtggtgcttcgacggggagcgcaacaaccaggtgctggaggagaacatggacgtcgagatctggaccaaggagggcgagcggaagaagctccgcccccggtggctggacgcccgcacctactccgacccgctggccctccgggagttcaaggagttcgccgcggggcgccggagcgtgagcggcgacctgatcctggagatcggcaagctcccccagcacctgaccctgcgcgcccagaacgccctcgacaacctggtgatgctgcacaactccgagcagggcgggaaggcctaccggcacgccatggaggagctccccgacaccatcgagacgctgatgctgctcgcgctgatcgccgtcctgaccgggggcgtgaccctcttcttcctgagcgggaagggcctgggcaagacctccatcgggctcctgtgcgtgatggccagctccgccctgctctggatggcgagcgtcgagccccactggatcgccgcctccatcatcctggagttcttcctgatggtgctcctgatcccggagcccgaccgccagcggacgccccaggacaaccagctggcctacgtggtcatcggcctcctgttcatgatcctgaccgtggccgcgaacgagatggggctcctggagaccaccaagaaggacctgggcatcgggcacgtggccgccgagaaccaccaccacgccacgatgctcgacgtcgacctgcgcccggccagcgcgtggaccctgtacgccgtggccaccaccgtgatcacgcccatgatgcggcacaccatcgagaacaccaccgccaacatctccctcacggccatcgcgaaccaggccgccatcctgatgggcctggacaagggctggcccatcagcaagatggacatcggggtccccctcctggccctgggctgctactcccaggtgaacccgctcaccctgaccgccaccgtgctgatgctcgtcgcgcactacgccatcatcgggcccggcctgcaggccaaggccacgcgcgaggcgcagaagcgcaccgccgccgggatcatgaagaaccccaccgtggacggcatcgtgaccatcgacctggaccccgtcgtgtacgacgccaagttcgagaagcagctcggccagatcatgctgctgatcctctgcacgagccagatcctgctgatgcggaccacctgggccctctgcgagtccatcaccctggcgacggggccgctgaccaccctctgggagggcagccccgggaagttctggaacaccacgatcgccgtgtccatggccaacatcttccgcggcagctacctggccggcgccgggctggcgttctccctcatgaagtccctgggcgggggccggcgcgggaccggcgcccagggcgagaccctgggggagaagtggaagcggcagctcaaccagctgtccaagagcgagttcaacacctacaagaagtccggcatcatggaggtcgaccgctccgaggccaaggaggggctgaagcggggcgagacgaccaagcacgccgtgagccgcgggaccgccaagctgcggtggttcgtggagcgcaacctcgtcaagcccgagggcaaggtgatcgacctgggctgcgggcggggcgggtggtcctactactgcgcgggcctgaagaaggtgaccgaggtcaaggggtacaccaagggcggccccgggcacgaggagccgatccccatggccacgtacggctggaacctcgtgaagctgcacagcgggaaggacgtgttcttcacgccgcccgagaagtgcgacaccctgctctgcgacatcggcgagtccagcccgaaccccaccatcgaggaggggcgcacgctgcgggtcctgaagatggtggagccctggctccgcggcaaccagttctgcatcaagatcctgaacccctacatgccgtccgtggtcgagaccctggagcagatgcagcggaagcacggcgggatgctcgtgcgcaaccccctgagccggaactccacccacgagatgtactgggtgagctgcggcaccgggaacatcgtctccgccgtgaacatgacgagccgcatgctgctcaaccggttcaccatggcccaccgcaagcccacctacgagcgcgacgtggacctgggcgcgggcacccggcacgtcgccgtggagcccgaggtggccaacctggacatcatcgggcagcgcatcgagaacatcaagaacgagcacaagtccacgtggcactacgacgaggacaacccgtacaagacctgggcctaccacggcagctacgaggtcaagccctccgggagcgcctccagcatggtgaacggcgtcgtgcggctcctgaccaagccctgggacgtgatccccatggtcacccagatcgcgatgacggacaccaccccgttcgggcagcagcgcgtgttcaaggagaaggtggacacccggacgccccgcgccaagcggggcaccgcccagatcatggaggtcaccgccaagtggctgtggggcttcctctcccgcaacaagaagccccggatctgcacccgcgaggagttcacgcggaaggtgcgcagcaacgccgcgatcggggccgtgttcgtcgacgagaaccagtggaacagcgccaaggaggccgtggaggacgagcggttctgggacctggtgcaccgcgagcgggagctgcacaagcagggcaagtgcgcgacctgcgtctacaacatgatggggaagcgcgagaagaagctcggcgagttcgggaaggcgaagggctcccgggccatctggtacatgtggctgggcgcccgcttcctggagttcgaggccctcgggttcatgaacgaggaccactggttcagccgggagaactccctgagcggcgtggagggggagggcctgcacaagctcgggtacatcctgcgcgacatctccaagatcccgggcggcaacatgtacgcggacgacaccgccgggtgggacacccggatcacggaggacgacctgcagaacgaggccaagatcaccgacatcatggagcccgagcacgccctcctggccaccagcatcttcaagctgacctaccagaacaaggtggtccgcgtgcagcgccccgcgaagtccggcacggtgatggacgtcatcagccggcgcgaccagcgggggtccggccaggtgggcacctacgggctcaacaccttcaccaacatggaggtgcagctgatccgccagatggagagcgagggcatcttctcccccagcgagctggagacgccgaacctcgccaagcgggtcctggactggctggagaagcacggggccgagcgcctcaagcggatggccatctccggcgacgactgcgtggtgaagcccatcgacgaccgcttcgccaccgcgctgaccgccctgaacgacatggggaaggtccggaaggacatcccccagtgggagcccagcaagggctggaacgactggcagcaggtcccgttctgctcccaccacttccaccagctcatcatgaaggacggccgcgacatcgtggtcccctgccggaaccaggacgagctggtggggcgcgcccgggtgagccagggcgccgggtggtccctgcgcgagaccgcctgcctcggcaagagctacgcgcagatgtggcagctgatgtacttccaccggcgcgacctgcggctcgccgccaacgccatctgcagcgccgtccccgtggactgggtgcccacctcccgcacgacctggagcatccacgcgcaccaccagtggatgaccaccgaggacatgctgtccgtctggaaccgggtgtggatcgaggagaacccgtggatggaggacaagacgcacgtgagctcctgggaggaggtcccctacctggggaagcgcgaggaccagtggtgcggcagcctcatcggcctgaccgcccgcgccacctgggccaccaacatccaggtggcgatcaaccaggtgcggcgcctgatcgggaacgagaactacctcgactacatgacgtccatgaagcggttcaagaacgagagcgaccccgagggcgccctgtggtga

SEQ ID NO: 7964 - RNA, 9879 nt, synthetic construct
  misc_feature 1..9879: note = derived and/or modified CDS sequence (opt1) from DENV-1__FJ850081__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgtgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacccgcaccgagacctggatgagctccgagggcgcgtggaagcagatccagaaggtggagacctgggccctgcggcaccccgggttcacggtgatcgccctgttcctcgcccacgcgatcggcaccagcatcacccagaaggggatcatcttcatcctgctgatgctcgtcaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgcccgacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttcctcacccaggacgagaagggggtcacccagaacggccgcctgatcacggccaacccgatcgtgaccgacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcgcgccggatggccatcctgggcgacacggcctgggacttcgggtccatcggcggcctgttcaccagcgtggggaagctcatccaccaggtcttcggcaccgcgtacggggtgctgttctccggcgtgagctggaccatgaagatcgggatcggcatcctgctcacgtggctgggcctgaactcccgcagcacctccctcagcatgacctgcatcgccgtcgggatggtgaccctgtacctgggcgtgatggtccaggccgactccgggtgcgtgatcaactggaagggccgcgagctcaagtgcgggagcggcatcttcgtgacgaacgaggtccacacctggaccgagcagtacaagttccaggccgactccccgaagcggctgagcgccgcgatcggcaaggcctgggaggagggggtgtgcggcatccgcagcgccacccggctggagaacatcatgtggaagcagatctccaacgagctcaactacatcctgctggagaacgacatgaagttcaccgtggtcgtgggggacgccaacggcatcctcgcccaggggaagaagatgatccgcccccagcccatggagcacaagtacagctggaagtcctggggcaaggcgaagatcatcggcgccgacatccagaacacgaccttcatcatcgacgggcccgacaccccggagtgccccgacgaccagcgggcctggaacatctgggaggtggaggactacggcttcgggatcttcaccacgaacatctggctgaagctgcgcgacagccacacccagatgtgcgaccaccggctcatgtccgccgcgatcaaggacagcaaggccgtccacgccgacatgggctactggatcgagtccgagaagaacgagacctggaagctggcccgcgccagcttcatcgaggtgaagacctgcatctggcccaagtcccacacgctgtggagcaacggcgtgctcgagtccgagatgatcatccccaagatctacgggggcccgatcagccagcacaactaccggcccgggtacttcacccagaccgcgggcccctggcacctggggaagctggagctcgacttcgacctgtgcgagggcaccacggtcgtggtggacgagcactgcggctaccgcgggccgtccctgcggaccaccaccgtcacgggcaagatcatccacgagtggtgctgccgcagctgcaccctgccgcccctgcggttccgcggggaggacggctgctggtacgggatggagatccggcccgtgaaggagaaggaggagaacctggtgcgctccatggtcagcgccggctccggcgaggtggacagcttcagcctcgggatcctgtgcgtgtccatcctgatcgaggaggtcatgcggagccgctggtcccggaagatgctcatgaccggcaccctggccgtgttcctgctcctgatcatggggcagctgacgtggaacgacctcatccgcctgtgcatcatggtgggcgccaacgccagcgaccgcatggggatgggcaccacctacctggccctcatggccaccttcaagatgcggccgatgttcgccgtcgggctgctgttccgccggctcacgtcccgcgaggtgctgctgctcaccatcgggctgagcctggtggcctccgtcgagctccccaacagcctggaggagctgggcgacgggctcgccatgggcatcatgatgctgaagctgctcaccgacttccagccccaccagctgtggaccacgctgctctccctgaccttcatccggaccagcctgtccctcgactacgcgtggaagaccatggccatggccctgagcatcgtgtccctgttccccctctgcctgagcacgacctcccagaagaccacctggctgccggtcctcctgggcagcttcgggtgcaagcccctgacgatgttcctcatcaccgagaacaagatctggggccgcaagtcctggcccatcaacgaggggatcatggccgtgggcatcgtgagcatcctgctgtccagcctcctgaagaacgacgtccccctggcggggccgctcatcgccggcggcatgctgatcgcctgctacgtgatcagcgggtccagcgccgacctgtccctcgagaaggccgcggaggtgagctgggaggaggaggccgagcactccggcaccagccacaacatcctggtcgaggtgcaggacgacgggaccatgaagatcaaggacgaggagcgggacgacaccctgacgatcctcctgaaggccaccctgctcgccgtgtccggcgtctaccccatgagcatccccgccaccctgttcgtgtggtacttctggcagaagaagaagcagcgctccggggtgctgtgggacacccccagcccgcccgaggtcgagcgggcggtgctggacgacggcatctaccgcatcctccagcggggcctgctggggcgctcccaggtgggcgtcggggtgttccaggacggcgtgttccacacgatgtggcacgtcacccgcggggccgtgctcatgtaccagggcaagcgcctggagcccagctgggcctccgtgaagaaggacctgatcagctacggcgggggctggcggttccaggggtcctggaacaccggcgaggaggtccaggtgatcgccgtggagcccgggaagaacccgaagaacgtccagaccacgcccggcaccttcaagacccccgagggcgaggtgggggccatcgcgctcgacttcaagcccggcaccagcgggtccccgatcgtgaaccgcgagggcaagatcgtcggcctgtacgggaacggcgtggtgacgaccagcgggacctacgtctccgccatcgcccaggccaaggccagccaggagggccccctgcccgagatcgaggacgaggtgttcaagaagcggaacctcaccatcatggacctgcacccggggagcggcaagacgcgccggtacctgcccgcgatcgtgcgcgaggccatcaagcggaagctccgcaccctgatcctggcccccacccgcgtcgtggcctccgagatggcggaggccctcaagggcatgcccatccggtaccagaccacggccgtcaagagcgagcacaccgggcgcgagatcgtcgacctgatgtgccacgccaccttcaccatgcggctgctctccccggtgcgcgtgcccaactacaacatgatcatcatggacgaggcccacttcacggaccccgcgagcatcgccgcccggggctacatctccacccgcgtcgggatgggcgaggccgccgcgatcttcatgaccgccacgccgcccgggagcgccgaggccttcccccagtccaacgccgtgatccaggacgaggagcgggacatccccgagcgcagctggaactccggctacgactggatcacggacttccccggcaagaccgtgtggttcgtccccagcatcaagtccgggaacgacatcgcgaactgcctgcggaagaacggcaagcgcgtgatccagctgagccggaagaccttcgacaccgagtaccagaagacgaagaacaacgactgggactacgtggtcaccaccgacatctccgagatgggggccaacttccgcgccgaccgggtgatcgacccccgccggtgcctcaagcccgtgatcctgaaggacggccccgagcgcgtcatcctggccgggccgatgcccgtgaccgtggcgagcgccgcccagcggcgcggccggatcggccgcaaccagaacaaggagggggaccagtacatctacatgggccagcccctcaacaacgacgaggaccacgcccactggacggaggccaagatgctgctggacaacatcaacacccccgaggggatcatcccggccctcttcgagcccgagcgcgagaagtccgccgccatcgacggcgagtaccggctgcgcggggaggcccggaagaccttcgtcgagctgatgcgccggggcgacctccccgtgtggctgagctacaaggtcgcctccgagggcttccagtacagcgaccgccggtggtgcttcgacggggagcgcaacaaccaggtgctggaggagaacatggacgtggagatctggaccaaggagggcgagcggaagaagctccgcccccggtggctggacgcgcgcacgtactccgacccgctggccctccgggagttcaaggagttcgccgccgggcgccggagcgtcagcggcgacctgatcctggagatcggcaagctcccccagcacctgaccctgcgcgcccagaacgcgctcgacaacctggtgatgctgcacaactccgagcagggcgggaaggcctaccggcacgccatggaggagctccccgacaccatcgagaccctgatgctgctcgccctgatcgcggtgctgaccgggggcgtcaccctcttcttcctgagcgggaagggcctgggcaagacctccatcgggctcctgtgcgtgatggccagctccgccctgctctggatggccagcgtggagccccactggatcgccgcgtccatcatcctggagttcttcctgatggtcctcctgatcccggagcccgaccgccagcggacgccccaggacaaccagctggcctacgtggtgatcggcctcctgttcatgatcctgaccgtcgccgccaacgagatggggctcctggagacgaccaagaaggacctgggcatcgggcacgtggccgcggagaaccaccaccacgccaccatgctcgacgtggacctgcgcccggccagcgcctggaccctgtacgccgtcgcgacgaccgtgatcacccccatgatgcggcacaccatcgagaacacgaccgccaacatctccctcaccgccatcgccaaccaggccgcgatcctgatgggcctggacaagggctggcccatcagcaagatggacatcggggtgcccctcctggccctgggctgctactcccaggtcaacccgctcaccctgacggccgccgtgctgatgctcgtggcgcactacgccatcatcgggcccggcctgcaggccaaggccacccgcgaggcccagaagcgcaccgcggccgggatcatgaagaaccccaccgtcgacggcatcgtgacgatcgacctggaccccgtggtctacgacgccaagttcgagaagcagctcggccagatcatgctgctgatcctctgcaccagccagatcctgctgatgcggaccacctgggccctctgcgagtccatcacgctggccaccgggccgctgaccaccctctgggagggcagccccgggaagttctggaacacgaccatcgcggtgtccatggccaacatcttccgcggcagctacctggccggcgccgggctggccttctccctcatgaagtccctgggcgggggccggcgcgggaccggcgcgcagggcgagaccctgggggagaagtggaagcggcagctcaaccagctgtccaagagcgagttcaacacgtacaagaagtccggcatcatggaggtggaccgctccgaggccaaggaggggctgaagcggggcgagaccaccaagcacgccgtcagccgcgggaccgccaagctgcggtggttcgtggagcgcaacctcgtgaagcccgagggcaaggtcatcgacctgggctgcgggcggggcgggtggtcctactactgcgcgggcctgaagaaggtgacggaggtgaaggggtacaccaagggcggccccgggcacgaggagccgatccccatggccacctacggctggaacctcgtcaagctgcacagcgggaaggacgtgttcttcacgccgcccgagaagtgcgacaccctgctctgcgacatcggcgagtccagcccgaaccccacgatcgaggaggggcgcaccctgcgggtgctgaagatggtcgagccctggctccgcggcaaccagttctgcatcaagatcctgaacccctacatgccgtccgtggtggagaccctggagcagatgcagcggaagcacggcgggatgctcgtccgcaaccccctgagccggaactccacccacgagatgtactgggtgagctgcggcacggggaacatcgtgtccgccgtcaacatgaccagccgcatgctgctcaaccggttcaccatggcccaccgcaagcccacctacgagcgcgacgtggacctgggcgccggcacgcggcacgtggcggtcgagcccgaggtggccaacctggacatcatcgggcagcgcatcgagaacatcaagaacgagcacaagtccacctggcactacgacgaggacaacccgtacaagacctgggcctaccacggcagctacgaggtgaagccctccgggagcgcctccagcatggtcaacggcgtggtgcggctcctgaccaagccctgggacgtcatccccatggtgacgcagatcgccatgaccgacaccaccccgttcgggcagcagcgcgtcttcaaggagaaggtggacacgcggacgccccgggcgaagcggggcaccgcccagatcatggaggtgaccgccaagtggctgtggggcttcctctcccgcaacaagaagccccggatctgcacgcgcgaggagttcacccggaaggtccgcagcaacgccgccatcggggcggtgttcgtggacgagaaccagtggaacagcgccaaggaggccgtcgaggacgagcggttctgggacctggtgcaccgcgagcgggagctgcacaagcagggcaagtgcgcgacctgcgtgtacaacatgatggggaagcgcgagaagaagctcggcgagttcgggaaggcgaagggctcccgggccatctggtacatgtggctgggcgcccgcttcctggagttcgaggccctcgggttcatgaacgaggaccactggttcagccgggagaactccctgagcggcgtcgagggggagggcctgcacaagctcgggtacatcctgcgcgacatctccaagatcccgggcggcaacatgtacgccgacgacaccgcggggtgggacacgcggatcaccgaggacgacctgcagaacgaggccaagatcaccgacatcatggagcccgagcacgccctcctggccaccagcatcttcaagctgacgtaccagaacaaggtggtgcgcgtccagcgccccgccaagtccggcaccgtgatggacgtgatcagccggcgcgaccagcgggggtccggccaggtcggcacctacgggctcaacaccttcacgaacatggaggtgcagctgatccgccagatggagagcgagggcatcttctcccccagcgagctggagaccccgaacctcgcgaagcgggtgctggactggctggagaagcacggggccgagcgcctcaagcggatggccatctccggcgacgactgcgtcgtgaagcccatcgacgaccgcttcgccaccgccctgaccgcgctgaacgacatggggaaggtgcggaaggacatcccccagtgggagcccagcaagggctggaacgactggcagcaggtcccgttctgctcccaccacttccaccagctcatcatgaaggacggccgcgagatcgtggtgccctgccggaaccaggacgagctggtcgggcgcgcccgggtgagccagggcgccgggtggtccctgcgcgagacggcctgcctcggcaagagctacgcccagatgtggcagctgatgtacttccaccggcgcgacctgcggctcgcggccaacgccatctgcagcgccgtgcccgtcgactgggtgcccacctcccgcaccacctggagcatccacgcgcaccaccagtggatgaccacggaggacatgctgtccgtgtggaaccgggtctggatcgaggagaacccgtggatggaggacaagacccacgtgagctcctgggaggaggtgccctacctggggaagcgcgaggaccagtggtgcggcagcctcatcggcctgaccgcccgcgccacctgggccacgaacatccaggtcgccatcaaccaggtgcggcgcctgatcgggaacgagaactacctcgactacatgacctccatgaagcggttcaagaacgagagcgaccccgagggcgcgctgtggtga

SEQ ID NO: 7965 - RNA, 9879 nt, synthetic construct
  misc_feature 1..9879: note = derived and/or modified CDS sequence (opt1) from DENV-1__FJ850084__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagaccagcgtgggggtgaacatgtgcaccctgatcgcgatggacctgggcgagctctgcgaggacaccatgacctacaagtgcccccgcatcaccgaggtggagcccgacgacgtggactgctggtgcaacgccaccgacacctgggtgacctacgggacctgcagccagaccggcgagcaccggcgcgacaagcggtccgtcgccctggcgccccacgtgggcctggggctcgagacgcgcaccgagacctggatgagctccgagggcgcctggaagcagatccagaaggtggagacctgggcgctgcggcaccccgggttcacggtcatcgccctgttcctcgcccacgccatcggcaccagcatcacccagaaggggatcatcttcatcctgctgatgctcgtgaccccctccatggcgatgcgctgcgtgggcatcggcaaccgggacttcgtcgaggggctgagcggcgccacgtgggtggacgtggtcctggagcacgggtcctgcgtgaccaccatggccaagaacaagcccaccctcgacatcgagctgctgaagacggaggtgaccaaccccgccgtcctccgcaagctgtgcatcgaggccaagatcagcaacaccaccacggactcccggtgcccgacccagggcgaggcgaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtccacaccggcgaccagcaccaggtggggaacgagacgaccgagcacggcaccatcgccaccatcacgccccaggcccccacgagcgagatccagctgaccgactacggggcgctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgccaagaagcaggaggtggtcgtgctgggctcccaggagggcgccatgcacaccgcgctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtcgccgagacccagcacggcacggtgctggtgcaggtcaagtacgagggcaccgacgccccctgcaagatccccttcctcacccaggacgagaagggggtgacccagaacggccgcctgatcacggcgaacccgatcgtgaccgacaaggagaagcccgtcaacatcgagaccgagccgcccttcggggagtcctacatcgtggtgggcgccggcgagaaggccctgaagctcagctggttcaagaaggggtccagcatcggcaagatgttcgaggccaccgcgcgcggggcccgccggatggccatcctgggcgacacggcctgggacttcgggtccatcggcggcctgttcaccagcgtcgggaagctcatccaccaggtgttcggcgccgcgtacggggtgctgttctccggcgtcagctggaccatgaagatcgggatcggcatcctgctcacctggctgggcctgaactcccgcagcacgtccctcagcatgacctgcatcgccgtggggatggtgaccctgtacctgggcgtcatggtgcaggccgactccgggtgcgtgatcaactggaagggccgcgagctcaagtgcgggagcggcatcttcgtcaccaacgaggtgcacacgtggaccgagcagtacaagttccaggccgactccccgaagcggctgagcgccgcgatcggcaaggcctgggaggagggggtgtgcggcatccgcagcgccacccggctggagaacatcatgtggaagcagatctccaacgagctcaactacatcctgctggagaacgacatgaagttcaccgtcgtggtgggggacgccaacggcatcctcacccaggggaagaagatgatccgcccccagcccatggagcacaagtacagctggaagtcctggggcaaggccaagatcatcggcgcggacatccagaacacgaccttcatcatcgacgggcccgacaccccggagtgccccgacgaccagcgggcctggaacatctgggaggtcgaggactacggcttcgggatcttcaccacgaacatctggctgaagctgcgcgacagctacacccagatgtgcgaccaccggctcatgtccgccgccatcaaggacagcaaggcggtgcacgccgacatgggctactggatcgagtccgagaagaacgagacctggaagctggcccgcgccagcttcatcgaggtgaagacctgcatctggcccaagtcccacacgctgtggagcaacggcgtcctcgagtccgagatgatcatccccaagatctacgggggcccgaccagccagcacaactaccggcccgggtacttcacccagaccgccggcccctggcacctggggaagctggagctcgacttcgacctgtgcgagggcacgaccgtggtggtcgacgagcactgcggctaccgcgggccgtccctgcggaccaccacggtgaccggcaagatcatccacgagtggtgctgccgcagctgcaccctgccgcccctgcggttccgcggggaggacggctgctggtacgggatggagatccggcccgtgaaggagaaggaggagaacctggtccgctccatggtgagcgcgggctccgccgaggtggacagcttcagcctcggcatcctgtgcgtctccatcctgatcgaggaggtgatgcggagccgctggtcccggaagatgctcatgaccgggacgctggccgtgttcctgctcctgatcatgggccagctgacctggaacgacctcatccgcctgtgcatcatggtcggggccaacgccagcgaccgcatgggcatggggaccacctacctggccctcatggccacgttcaagatgcggccgatgttcgccgtggggctgctgttccgcaagctcacctcccgggaggtgctgctgctcaccatcggcctgagcctggtcgcctccgtggagctccccaacagcctggaggagctgggggacggcctcgccatggggatcatgatgctgaagctgctcaccgacttccagccccaccagctgtggacgaccctgctctccctgaccttcatccgcaccagcctgtccctcgactacgcgtggaagacgatggccatggccctgagcatcgtctccctgttccccctctgcctgagcaccacctcccagaagaccacgtggctgccggtgctcctgggcagcttcggctgcaagcccctgaccatgttcctcatcaccgagaacaagatctgggggcggaagtcctggcccatcaacgagggcatcatggccgtggggatcgtcagcatcctgctgtccagcctcctgaagaacgacgtgcccctggcgggcccgctcatcgccgggggcatgctgatcgcctgctacgtgatcagcggctccagcgccgacctgtccctcgagaaggccgcggaggtcagctgggaggaggaggccgagcactccgggaccagccacaacatcctggtggaggtgcaggacgacggcaccatgaagatcaaggacgaggagcgcgacgacacgctgaccatcctcctgaaggccaccctgctcgccgtctccggggtgtaccccatgagcatccccgccaccctgttcgtgtggtacttctggcagaagaagaagcagcggtccggcgtcctgtgggacacgcccagcccgcccgaggtggagcgcgcggtgctggacgacgggatctaccggatcctccagcgcggcctgctgggccggtcccaggtcggggtgggcgtgttccaggacggggtcttccacaccatgtggcacgtgacccgcggcgccgtgctcatgtaccaggggaagcggctggagcccagctgggcctccgtcaagaaggacctgatcagctacggcggcgggtggcgcttccagggctcctggaacaccggggaggaggtccaggtgatcgccgtcgagcccggcaagaacccgaagaacgtgcagacgacccccgggaccttcaagacccccgagggcgaggtgggcgccatcgcgctcgacttcaagcccgggacgagcggctccccgatcgtcaaccgggaggggaagatcgtgggcctgtacggcaacggggtggtcaccaccagcggcacctacgtgtccgccatcgcccaggccaaggccagccaggaggggcccctgcccgagatcgaggacgaggtgttcaagaagcgcaacctcacgatcatggacctgcacccgggcagcgggaagacccggcgctacctgcccgcgatcgtccgggaggccatcaagcgcaagctccggaccctgatcctggcccccacccgcgtggtggcctccgagatggcggaggccctcaagggcatgcccatccgctaccagacgaccgccgtcaagagcgagcacaccggccgggagatcgtggacctgatgtgccacgccaccttcacgatgcgcctgctctccccggtgcgggtccccaactacaacatgatcatcatggacgaggcccacttcaccgaccccgcgagcatcgccgcccgcgggtacatctccacccgggtgggcatgggggaggccgccgcgatcttcatgaccgccacgcccccgggcagcgtggaggccttcccccagtccaacgccgtcatccaggacgaggagcgcgacatccccgagcggagctggaactccgggtacgactggatcaccgacttccccggcaagaccgtgtggttcgtgccgagcatcaagtccggcaacgacatcgccaactgcctgcgcaagaacgggaagcgggtcatccagctgagccgcaagaccttcgacacggagtaccagaagaccaagaacaacgactgggactacgtggtgaccaccgacatctccgagatgggcgcgaacttccgggccgaccgcgtcatcgacccccggcgctgcctcaagcccgtgatcctgaaggacgggcccgagcgggtgatcctggccggcccgatgcccgtcacggtggccagcgcggcccagcgccgggggcgcatcggccggaaccagaacaaggagggcgaccagtacatctacatggggcagcccctcaacaacgacgaggaccacgcccactggaccgaggccaagatgctgctggacaacatcaacacccccgagggcatcatcccggccctcttcgagcccgagcgcgagaagtccgcggccatcgacggggagtaccgcctgcggggcgaggcccgcaagaccttcgtcgagctgatgcggcgcggggacctccccgtgtggctgagctacaaggtggcctccgagggcttccagtacagcgaccggcgctggtgcttcgacggcgagcggaacaaccaggtcctggaggagaacatggacgtggagatctggacgaaggagggggagcgcaagaagctccggccccgctggctggacgcccggacctactccgacccgctggcgctccgcgagttcaaggagttcgccgccggccggcgcagcgtgagcggggacctgatcctggagatcggcaagctcccccagcacctgaccctgcgggcccagaacgccctcgacaacctggtcatgctgcacaactccgagcagggcgggaaggcgtaccgccacgccatggaggagctccccgacaccatcgagaccctgatgctgctcgccctgatcgccgtgctgacgggcggggtgaccctcttcttcctgagcggcaaggggctgggcaagacctccatcggcctcctgtgcgtcatggcgagctccgccctgctctggatggccagcgtggagccccactggatcgccgcctccatcatcctggagttcttcctgatggtgctcctgatcccggagcccgaccggcagcgcacgccccaggacaaccagctggcgtacgtcgtgatcgggctcctgttcatgatcctgacggtggccgccaacgagatgggcctcctggagaccaccaagaaggacctggggatcggccacgtcgccgccgagaaccaccaccacgcgaccatgctcgacgtggacctgcggccggccagcgcctggacgctgtacgccgtggccaccaccgtcatcacccccatgatgcgccacacgatcgagaacaccaccgcgaacatctccctcaccgccatcgccaaccaggccgccatcctgatggggctggacaagggctggcccatcagcaagatggacatcggcgtgcccctcctggcgctggggtgctactcccaggtgaacccgctcacgctgaccgccaccgtcctgatgctcgtggcccactacgccatcatcggccccgggctgcaggcgaaggccacccgggaggcccagaagcgcacggccgccggcatcatgaagaaccccaccgtggacgggatcgtcaccatcgacctggaccccgtggtgtacgacgcgaagttcgagaagcagctcggccagatcatgctgctgatcctctgcaccagccagatcctgctgatgcgcacgacctgggccctctgcgagtccatcaccctggccaccggcccgctgacgaccctctgggaggggagccccggcaagttctggaacaccaccatcgccgtctccatggccaacatcttccgggggagctacctggcgggcgccggcctggccttctccctcatgaagtccctcgggggcgggcgccgggggacgggggcccagggcgagaccctgggcgagaagtggaagcgccagctcaaccagctgtccaagagcgagttcaacacctacaagaagtccgggatcatggaggtggaccggtccgaggccaaggagggcctgaagcgcggggagaccacgaagcacgcggtgagccggggcaccgccaagctgcgctggttcgtcgagcggaacctcgtgaagcccgaggggaaggtgatcgacctgggctgcggccgcgggggctggtcctactactgcgccgggctgaagaaggtcaccgaggtgaagggctacaccaagggcgggcccggccacgaggagccgatccccatggccacctacgggtggaacctcgtgaagctgcacagcggcaaggacgtcttcttcacgccgcccgagaagtgcgacaccctgctctgcgacatcggggagtccagcccgaaccccaccatcgaggagggccggaccctgcgcgtgctgaagatggtggagccctggctccgggggaaccagttctgcatcaagatcctgaacccctacatgccgtccgtcgtggagacgctggagcagatgcagcgcaagcacggcggcatgctcgtgcggaaccccctgagccgcaactccacccacgagatgtactgggtcagctgcgggaccggcaacatcgtgtccgcggtgaacatgaccagccggatgctgctcaaccgcttcacgatggcccaccggaagcccacctacgagcgcgacgtcgacctgggggccggcacccgccacgtggccgtggagcccgaggtcgccaacctggacatcatcggccagcggatcgagaacatcaagaacgagcacaagtccacctggcactacgacgaggacaacccgtacaagacgtgggcgtaccacgggagctacgaggtgaagccctccggcagcgcctccagcatggtgaacggggtcgtgcgcctcctgaccaagccctgggacgtcatccccatggtgacccagatcgccatgaccgacacgaccccgttcggccagcagcgggtgttcaaggagaaggtcgacacccgcacgccccgggccaagcgcgggacggcccagatcatggaggtgaccgcgaagtggctgtggggcttcctctcccggaacaagaagccccgcatctgcacccgggaggagttcacccgcaaggtgcggagcaacgccgccatcggcgccgtcttcgtggacgagaaccagtggaacagcgccaaggaggcggtggaggacgagcgcttctgggacctggtccaccgggagcgcgagctgcacaagcaggggaagtgcgccacgtgcgtgtacaacatgatgggcaagcgggagaagaagctcggggagttcggcaaggccaaggggtcccgcgccatctggtacatgtggctgggcgcgcggttcctggagttcgaggccctcggcttcatgaacgaggaccactggttcagccgcgagaactccctgagcggggtggagggcgaggggctgcacaagctcggctacatcctgcgggacatctccaagatccccggcgggaacatgtacgccgacgacaccgccgggtgggacacccgcatcaccgaggacgacctgcagaacgaggccaagatcacggacatcatggagcccgagcacgcgctcctggccaccagcatcttcaagctgacctaccagaacaaggtcgtgcgggtgcagcgccccgccaagtccgggaccgtcatggacgtgatcagccgccgggaccagcgcggctccggccaggtgggcacgtacggcctcaacaccttcaccaacatggaggtccagctgatccggcagatggagagcgaggggatcttctcccccagcgagctggagaccccgaacctcgccaagcgcgtgctggactggctggagaagcacggcgccgagcggctcaagcgcatggcgatctccggggacgactgcgtggtcaagcccatcgacgaccggttcgccacggccctgaccgccctgaacgacatgggcaaggtgcgcaaggacatcccccagtgggagcccagcaaggggtggaacgactggcagcaggtcccgttctgctcccaccacttccaccagctcatcatgaaggacggccgggacatcgtcgtgccctgccgcaaccaggacgagctggtgggccgggcccgcgtcagccagggggcgggctggtccctgcgggagaccgcctgcctcggcaagagctacgcccagatgtggcagctgatgtacttccaccgccgggacctgcgcctcgccgccaacgcgatctgcagcgccgtgcccgtggactgggtccccacctcccggaccacgtggagcatccacgcccaccaccagtggatgaccaccgaggacatgctgtccgtgtggaaccgcgtgtggatcgaggagaacccgtggatggaggacaagacccacgtcagctcctgggaggaggtgccctacctgggcaagcgggaggaccagtggtgcgggagcctcatcggcctgacggcccgcgcgacctgggccaccaacatccaggtggccatcaaccaggtccgccggctgatcggcaacgagaactacctcgactacatgacctccatgaagcgcttcaagaacgagagcgaccccgagggggccctgtggtga

SEQ ID NO: 7966 - RNA, 9879 nt, synthetic construct
  misc_feature 1..9879: note = derived and/or modified CDS sequence (opt1) from DENV-1__FJ850087__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgtgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacgcgcaccgagacctggatgagctccgagggcgcgtggaagcagatccagaaggtggagacctgggccctgcggcaccccgggttcacggtgatcgccctgttcctcgcccacgcgatcggcaccagcatcacccagaaggggatcatcttcatcctgctgatgctcgtcaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgccccacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttcctcacccaggacgagaagggggtcacccagaacggccgcctgatcacggccaacccgatcgtgaccgacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcccgccggatggccatcctgggcgacacggcctgggacttcgggtccatcggcggcctgttcaccagcgtggggaagctcatccaccaggtcttcggcaccgcgtacggggtgctgttctccggcgtgagctggaccatgaagatcgggatcggcatcctgctcacgtggctgggcctgaactcccgcagcacctccctcagcatgacctgcatcgccgtcgggatggtgaccctgtacctgggcgtgatggtccaggccgactccgggtgcgtgatcaactggaagggccgcgagctcaagtgcgggagcggcatcttcgtgacgaacgaggtccacacctggaccgagcagtacaagttccaggccgactccccgaagcggctgagcgccgcgatcggcaaggcctgggaggagggggtgtgcggcatccgcagcgccacccggctggagaacatcatgtggaagcagatctccaacgagctcaactacatcctgctggagaacgacatgaagttcaccgtggtcgtgggggacgtgaacggcatcctcgcccaggggaagaagatgatccgcccccagcccatggagcacaagtacagctggaagtcctggggcaaggccaagatcatcggcgcggacatccagaacacgaccttcatcatcgacgggcccgacaccccggagtgccccgacgaccagcgggcctggaacatctgggaggtcgaggactacggcttcgggatcttcaccacgaacatctggctgaagctgcgcgacagccacacccagatgtgcgaccaccggctcatgtccgccgccatcaaggacagcaaggcggtgcacgccgacatgggctactggatcgagtccgagaagaacgagacctggaagctggcccgcgccagcttcatcgaggtgaagacctgcatctggcccaagtcccacacgctgtggagcaacggcgtcctcgagtccgagatggtgatccccaagatctacgggggcccgatcagccagcacaactaccggcccgggtacttcacccagaccgccggcccctggcacctggggaagctggagctcgacttcgacctgtgcgagggcaccacggtggtcgtggacgagcactgcggctaccgcgggccgtccctgcggaccaccaccgtgacgggcaagatcatccacgagtggtgctgccgcagctgcaccctgccgcccctgcggttccgcggggaggacggctgctggtacgggatggagatccggcccgtcaaggagaaggaggagaacctggtgcgctccatggtgagcgcgggctccggcgaggtcgacagcttcagcctcgggatcctgtgcgtgtccatcctgatcgaggaggtgatgcggagccgctggtcccggaagatgctcatgaccggcaccctggtcgtgttcctgctcctgatcatggggcagctgacgtggaacgacctcatccgcctgtgcatcatggtgggcgccaacgccagcgaccgcatggggatgggcaccacctacctggccctcatggccaccttcaagatgcggccgatgttcgcggtcggcctgctgttccgccggctcacgtcccgcgaggtgctgctgctcaccgtcgggctgagcctggtggcctccgtggagctccccaacagcctggaggagctgggcgacgggctcgccatgggcatcatgatgctgaagctgctcaccgacttccagccccaccagctgtggaccacgctgctctccctgaccttcatccggaccagcctgtccctcgactacgcctggaagaccatggccatggcgctgagcatcgtctccctgttccccctctgcctgagcacgacctcccagaagaccacctggctgccggtgctcctgggcagcttcgggtgcaagcccctgacgatgttcctcatcaccgagaacaagatctggggccgcaagtcctggcccatcaacgaggggatcatggccgtgggcatcgtcagcatcctgctgtccagcctcctgaagaacgacgtgcccctggccgggccgctcatcgccggcggcatgctgatcgcgtgctacgtgatcagcgggtccagcgccgacctgtccctcgagaaggccgccgaggtcagctgggaggaggaggccgagcactccggcaccagccacaacatcctggtggaggtgcaggacgacgggaccatgaagatcaaggacgaggagcgggacgacaccctgacgatcctcctgaaggcgaccctgctcgccgtctccggcgtgtaccccatgagcatccccgccaccctgttcgtgtggtacttctggcagaagaagaagcagcgctccggggtcctgtgggacacccccagcccgcccgaggtggagcgggccgtgctggacgacggcatctaccgcatcctccagcggggcctgctggggcgctcccaggtcggcgtgggggtgctccaggacggcgtcttccacacgatgtggcacgtgacccgcggggccgtgctgatgtaccagggcaagcgcctggagcccagctgggcgtccgtcaagaaggacctcatcagctacggcgggggctggcggttccaggggtcctggaacaccggcgaggaggtccaggtgatcgccgtcgagcccgggaagaacccgaagaacgtgcagaccacgcccggcaccttcaagacccccgagggcgaggtgggggccatcgccctggacttcaagcccggcaccagcgggtccccgatcgtcaaccgcgagggcaagatcgtgggcctgtacgggaacggcgtggtcacgaccagcgggacctacgtgtccgccatcgcgcaggccaaggccacccaggagggccccctccccgagatcgaggacgaggtgttcaagaagcggaacctgacgatcatggacctgcacccggggagcggcaagacccgccggtacctccccgccatcgtccgcgaggccatcaagcggaagctgcgcaccctgatcctcgcgcccacccgcgtggtggccagcgagatggccgaggccctgaagggcatgcccatccggtaccagacgaccgcggtcaagtccgagcacaccgggcgcgagatcgtggacctgatgtgccacgccaccttcacgatgcggctcctgagcccggtgcgcgtccccaactacaacatgatcatcatggacgaggcccacttcaccgaccccgcctccatcgccgcgcggggctacatcagcacccgcgtggggatgggcgaggccgccgccatcttcatgaccgccacgcccccggggtccgtggaggcgttcccccagagcaacgccgtcatccaggacgaggagcgggacatccccgagcgctcctggaacagcggctacgactggatcaccgacttccccggcaagaccgtgtggttcgtgccgtccatcaagagcgggaacgacatcgccaactgcctgcggaagaacggcaagcgcgtcatccagctctcccggaagaccttcgacacggagtaccagaagaccaagaacaacgactgggactacgtggtgaccaccgacatcagcgagatgggggccaacttccgcgccgaccgggtcatcgacccccgccggtgcctgaagcccgtgatcctgaaggagggccccgagcgcgtcatcctcgcggggccgatgcccgtgacggtggcctccgccgcccagcggcgcggccggatcggccgcaaccagaacaaggagggggaccagtacatctacatgggccagcccctgaacaacgacgaggaccacgcgcactggaccgaggccaagatgctgctcgacaacatcaacacccccgaggggatcatcccggccctgttcgagcccgagcgcgagaagtccgccgccatcgacggcgagtaccggctgcgcggggaggcgcggaagaccttcgtcgagctcatgcgccggggcgacctgcccgtgtggctgtcctacaaggtggccagcgagggcttccagtactccgaccgccggtggtgcttcgacggggagcgcaacaaccaggtcctcgaggagaacatggacgtggagatctggacgaaggagggcgagcggaagaagctgcgcccccggtggctggacgcccgcacctacagcgacccgctcgccctgcgggagttcaaggagttcgccgcggggcgccggtccgtgagcggcgacctgatcctcgagatcggcaagctgccccagcacctgaccctccgcgcccagaacgccctggacaacctggtcatgctccacaacagcgagcagggcgggaaggcctaccggcacgccatggaggagctgcccgacaccatcgagaccctgatgctcctggcgctgatcgccgtgctcaccggcggggtgaccctgttcttcctgtccgggaaggggctcggcaagaccagcatcgggctgctgtgcgtcatggcctccagcgccctcctgtggatggcgtccgtggagccccactggatcgccgccagcatcatcctggagttcttcctcatggtgctgctgatcccggagcccgaccgccagcggacgccccaggacaaccagctcgcctacgtcgtgatcggcctgctgttcatgatcctcacggtggccgcgaacgagatggggctgctggagaccaccaagaaggacctcggcatcgggcacgtcgccgtggagaaccaccaccacgccaccatgctggacgtggacctgcgcccggcctccgcctggacgctctacgcggtcgccaccaccgtgatcacccccatgatgcggcacacgatcgagaacaccaccgccaacatcagcctgaccgccatcgccaaccaggcggccatcctgatgggcctcgacaagggctggcccatctccaagatggacatcggggtgcccctgctggccctcggctgctacagccaggtcaacccgctgacgctgaccgccgccgtgctcatgctggtggcgcactacgccatcatcgggcccggcctgcaggccaaggccacccgcgaggcgcagaagcgcaccgccgccgggatcatgaagaaccccacggtcgacggcatcgtgaccatcgacctcgaccccgtggtctacgacgccaagttcgagaagcagctgggccagatcatgctgctcatcctgtgcacctcccagatcctgctcatgcggaccacgtgggccctgtgcgagagcatcaccctggcgaccgggccgctcaccacgctgtgggagggctcccccgggaagttctggaacaccaccatcgccgtgagcatggccaacatcttccgcggctcctacctggccggcgccgggctcgcgttcagcctgatgaagtccctgggcgggggccggcgcgggaccggcgcccagggcgagacgctcggggagaagtggaagcggcagctgaaccagctgagcaagtccgagttcaacacctacaagaagtccggcatcatggaggtggaccgcagcgaggccaaggaggggctgaagcggggcgagaccaccaagcacgccgtctcccgcgggacggccaagctccggtggttcgtggagcgcaacctggtgaagcccgagggcaaggtcatcgacctgggctgcgggcggggcgggtggagctactactgcgcgggcctcaagaaggtgaccgaggtgaaggggtacaccaagggcggccccgggcacgaggagccgatccccatggccacctacggctggaacctggtcaagctgcactccgggaaggacgtgttcttcacgccgcccgagaagtgcgacacgctcctgtgcgacatcggcgagagctccccgaaccccaccatcgaggaggggcgcaccctgcgggtgctcaagatggtcgagccctggctgcgcggcaaccagttctgcatcaagatcctgaacccctacatgccgagcgtggtggagaccctcgagcagatgcagcggaagcacggcgggatgctggtccgcaaccccctgtcccggaacagcacgcacgagatgtactgggtgtcctgcggcaccgggaacatcgtgagcgccgtcaacatgacctcccgcatgctcctgaaccggttcaccatggcccaccgcaagcccacgtacgagcgcgacgtggacctgggcgcgggcacccggcacgtggccgtcgagcccgaggtggccaacctcgacatcatcgggcagcgcatcgagaacatcaagaacgagcacaagagcacctggcactacgacgaggacaacccgtacaagacctgggcctaccacggctcctacgaggtcaagcccagcgggtccgccagctccatggtgaacggcgtggtccggctgctgacgaagccctgggacgtgatccccatggtgacccagatcgcgatgaccgacaccacgccgttcgggcagcagcgcgtcttcaaggagaaggtggacacccggacgccccgggccaagcggggcaccgcccagatcatggaggtgacggccaagtggctctggggcttcctgagccgcaacaagaagccccggatctgcacccgcgaggagttcacccggaaggtccgctccaacgccgcgatcggggccgtgttcgtggacgagaaccagtggaacagcgccaaggaggccgtcgaggacgagcggttctgggacctggtgcaccgcgagcgggagctccacaagcagggcaagtgcgcgacctgcgtgtacaacatgatggggaagcgcgagaagaagctgggcgagttcgggaaggcgaagggcagccgggccatctggtacatgtggctgggcgcccgcttcctcgagttcgaggccctggggttcatgaacgaggaccactggttctcccgggagaacagcctgtccggcgtcgagggggagggcctccacaagctggggtacatcctgcgcgacatcagcaagatcccgggcggcaacatgtacgcggacgacacggccgggtgggacacccggatcaccgaggacgacctccagaacgaggccaagatcaccgacatcatggagcccgagcacgccctgctggccacgtccatcttcaagctcacctaccagaacaaggtggtgcgcgtccagcgccccgccaagagcggcaccgtgatggacgtgatctcccggcgcgaccagcgggggagcggccaggtcggcacctacgggctgaacacgttcaccaacatggaggtgcagctgatccgccagatggagtccgagggcatcttcagcccctccgagctcgagaccccgaacctggccaagaaggtgctggactggctcgagaagcacggggccgagcggctgaagcgcatggccatcagcggcgacgactgcgtcgtgaagcccatcgacgaccggttcgccaccgcgctgacggccctcaacgacatggggaaggtgcgcaaggacatcccccagtgggagccctccaagggctggaacgactggcagcaggtcccgttctgcagccaccacttccaccagctgatcatgaaggacggccgggagatcgtggtgccctgccgcaaccaggacgagctggtcgggcgggcccgcgtgtcccagggcgccgggtggagcctccgggagaccgcctgcctgggcaagtcctacgcgcagatgtggcagctgatgtacttccaccgccgggacctccgcctggccgccaacgccatctgcagcgccgtgcccgtcgactgggtgcccaccagccggaccacctggtccatccacgcgcaccaccagtggatgacgaccgaggacatgctgagcgtgtggaaccgcgtctggatcgaggagaacccgtggatggaggacaagacccacgtgtccagctgggaggaggtgccctacctcgggaagcgggaggaccagtggtgcggctccctgatcggcctgaccgcccgcgccacgtgggccaccaacatccaggtcgcgatcaaccaggtgcgccggctcatcgggaacgagaactacctggactacatgaccagcatgaagcgcttcaagaacgagtccgaccccgagggcgccctgtggtga

SEQ ID NO: 7967 - RNA, 9879 nt, synthetic construct
  misc_feature 1..9879: note = derived and/or modified CDS sequence (opt1) from DENV-1__FJ850090__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgtgggggtgaacatgtgcaccctgatcgcgatggacctgggcgagctctgcgaggacaccatgacctacaagtgcccccggatcaccgaggtggagcccgacgacgtggactgctggtgcaacgccaccgacacgtgggtgacctacgggacctgcagccagaccggcgagcaccggcgcgacaagcggtccgtcgccctggcgccccacgtgggcctggggctcgagacgcgcaccgagacctggatgagctccgagggcgcctggaagcagatccagaaggtggagacctgggcgctgcggcaccccgggttcacggtcatcgccctgttcctcgcccacgccatcggcaccagcatcacccagaaggggatcatcttcatcctgctgatgctcgtgaccccctccatggcgatgcgctgcgtgggcatcggcaaccgggacttcgtcgaggggctgagcggcgccacgtgggtggacgtggtcctggagcacgggtcctgcgtgaccaccatggccaagaacaagcccaccctcgacatcgagctgctgaagacggaggtgaccaaccccgccgtcctccgcaagctgtgcatcgaggccaagatcagcaacaccaccacggactcccggtgcccgacccagggcgaggcgaccctggtggaggagcaggacgccaacttcgtgtgccgccggaccttcgtcgaccgcggctgggggaacggctgcggcctcttcggcaaggggagcctgctgacgtgcgccaagttcaagtgcgtgaccaagctcgagggcaagatcgtgcagtacgagaacctgaagtactccgtcatcgtgaccgtccacaccggcgaccagcaccaggtggggaacgagacgaccgagcacggcaccatcgccaccatcacgccccaggcccccacgagcgagatccagctgaccgactacggggcgctcaccctggactgcagcccccggaccggcctggacttcaacgagatggtgctcctgacgatgaaggagaagtcctggctggtccacaagcagtggttcctcgacctgccgctgccctggacctccggggccagcaccagccaggagacctggaaccgccaggacctcctggtgacgttcaagaccgcccacgccaagaagcaggaggtggtcgtgctgggctcccaggagggcgccatgcacaccgcgctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtcgccgagacccagcacggcacggtgctggtgcaggtcaagtacgagggcaccgacgccccctgcaagatccccttcctcacccaggacgagaagggggtgatccagaacggccgcctgatcaccgcgaacccgatcgtgacggacaaggagaagcccgtcaacatcgagaccgagccgcccttcggggagtcctacatcgtggtgggcgccggcgagaaggccctgaagctcagctggttcaagaaggggtccagcatcggcaagatgttcgaggccaccgcgcgcggggcccgccggatggccatcctgggcgacaccgcctgggacttcgggtccatcggcggcctgttcacgagcgtcgggaagctcatccaccaggtgttcggcaccgcctacggggtgctgttctccggcgtcagctggaccatgaagatcgggatcggcatcctgctcacctggctgggcctgaactcccgcagcacgtccctcagcatgacctgcatcgcggtggggatggtgaccctgtacctgggcgtcatggtgcaggccgactccgggtgcgtgatcaactggaagggccgcgagctcaagtgcgggagcggcatcttcgtcaccaacgaggtgcacacgtggaccgagcagtacaagttccaggccgactccccgaagcggctgagcgccgccatcggcaaggcgtgggaggagggggtgtgcggcatccgcagcgccacccggctggagaacatcatgtggaagcagatctccaacgagctcaactacatcctgctggagaacgacatgaagttcaccgtcgtggtgggggacgccaacggcatcctcacccaggggaagaagatgatccgcccccagcccatggagcacaagtacagctggaagtcctggggcaaggccaagatcatcggcgccgacatccagaacacgaccttcatcatcgacgggcccgacaccccggagtgccccgacgaccagcgggcgtggaacatctgggaggtcgaggactacggcttcgggatcttcaccacgaacatctggctgaagctgcgcgacagccacacccagatgtgcgaccaccggctcatgtccgccgccatcaaggacagcaaggccgtgcacgcggacatgggctactggatcgagtccgagaagaacgagacctggaagctggcccgcgccagcttcatcgaggtgaagacctgcatctggcccaagtcccacacgctgtggagcaacggcgtcctcgagtccgagatgatcatccccaagatctacgggggcccgaccagccagcacaactaccggcccgggtacttcacccagaccgccggcccctggcacctggggaagctggagctcgacttcgacctgtgcgagggcacgaccgtggtggtcgacgagcactgcggctaccgcgggccgtccctgcggaccaccacggtgaccggcaagatcatccacgagtggtgctgccgcagctgcaccctgccgcccctgcggttccgcggggaggacggctgctggtacgggatggagatccggcccgtgaaggagaaggaggagaacctggtccgctccatggtgagcgccggctccggcgaggtggacagcttcagcctcgggatcctgtgcgtctccatcctgatcgaggaggtgatgcggagccgctggtcccggaagatgctcatgaccggcacgctggcggtgttcctgctcctgatcatggggcagctgacctggaacgacctcatccgcctgtgcatcatggtcggcgccaacgccagcgaccgcatggggatgggcaccacctacctggccctcatggccacgttcaagatgcggccgatgttcgccgtggggctgctgttccgcaagctcacctcccgggaggtgctgctgctcaccatcgggctgagcctggtcgcctccgtggagctccccaacagcctggaggagctgggcgacgggctcgccatgggcatcatgatgctgaagctgctcaccgacttccagccccaccagctgtggacgaccctgctctccctgaccttcatccgcaccagcctgtccctcgactacgcctggaagacgatggccatggcgctgagcatcgtctccctgttccccctctgcctgagcaccacctcccagaagaccacgtggctgccggtgctcctgggcagcttcgggtgcaagcccctgaccatgttcctcatcaccgagaacaagatctggggccggaagtcctggcccatcaacgaggggatcatggccgtgggcatcgtcagcatcctgctgtccagcctcctgaagaacgacgtgcccctggccgggccgctcatcgccggcggcatgctgatcgcgtgctacgtgatcagcgggtccagcgccgacctgtccctcgagaaggccgccgaggtcagctgggaggaggaggccgagcactccggcaccagccacaacatcctggtggaggtgcaggacgacgggaccatgaagatcaaggacgaggagcgcgacgacacgctgaccatcctcctgaaggcgaccctgctcgccgtctccggcgtgtaccccatgagcatccccgccaccctgttcgtgtggtacttctggcagaagaagaagcagcggtccggggtcctgtgggacacgcccagcccgcccgaggtggagcgcgccgtgctggacgacggcatctaccggatcctccagcgcggcctgctggggcggtcccaggtcggcgtgggggtgttccaggacggcgtcttccacaccatgtggcacgtgacccgcggggccgtgctcatgtaccagggcaagcggctggagcccagctgggcgtccgtcaagaaggacctgatcagctacggcgggggctggcgcttccaggggtcctggaacaccggcgaggaggtccaggtgatcgccgtcgagcccgggaagaacccgaagaacgtgcagacgacccccggcaccttcaagacccccgagggcgaggtgggggccatcgccctcgacttcaagcccggcacgagcgggtccccgatcgtcaaccgggagggcaagatcgtgggcctgtacgggaacggcgtggtcaccaccagcgggacctacgtgtccgccatcgcgcaggccaaggccagccaggagggccccctgcccgagatcgaggacgaggtgttcaagaagcgcaacctcacgatcatggacctgcacccggggagcggcaagacccggcgctacctgcccgccatcgtccgggaggccatcaagcgcaagctccggaccctgatcctggcgcccacccgcgtggtggcctccgagatggccgaggccctcaagggcatgcccatccgctaccagacgaccgcggtcaagagcgagcacaccgggcgggagatcgtggacctgatgtgccacgccaccttcacgatgcgcctgctctccccggtgcgggtccccaactacaacatgatcatcatggacgaggcccacttcaccgaccccgccagcatcgccgcgcgcggctacatctccacccgggtggggatgggcgaggccgccgccatcttcatgaccgccacgcccccggggagcgtggaggcgttcccccagtccaacgccgtcatccaggacgaggagcgcgacatccccgagcggagctggaactccggctacgactggatcaccgacttccccggcaagaccgtgtggttcgtgccgagcatcaagtccgggaacgacatcgccaactgcctgcgcaagaacggcaagcgggtcatccagctgagccgcaagaccttcgacacggagtaccagaagaccaagaacaacgactgggactacgtggtgaccaccgacatctccgagatgggggccaacttccgggccgaccgcgtcatcgacccccggcgctgcctcaagcccgtgatcctgaaggacggccccgagcgggtgatcctggcggggccgatgcccgtcacggtggccagcgccgcccagcgccggggccgcatcggccggaaccagaacaaggagggggaccagtacatctacatgggccagcccctcaacaacgacgaggaccacgcgcactggaccgaggccaagatgctgctggacaacatcaacacccccgaggggatcatcccggccctcttcgagcccgagcgcgagaagtccgccgccatcgacggcgagtaccgcctgcgcggggaggcgcgcaagaccttcgtcgagctgatgcggcgcggcgacctccccgtgtggctgagctacaaggtggcctccgagggcttccagtacagcgaccggcgctggtgcttcgacggggagcggaacaaccaggtcctggaggagaacatggacgtggagatctggacgaaggagggcgagcgcaagaagctccggccccgctggctggacgcccggacctactccgacccgctggccctccgcgagttcaaggagttcgccgcggggcggcgcagcgtgagcggcgacctgatcctggagatcggcaagctcccccagcacctgaccctgcgggcccagaacgccctcgacaacctggtcatgctgcacaactccgagcagggcgggaaggcctaccgccacgccatggaggagctccccgacaccatcgagaccctgatgctgctcgcgctgatcgccgtgctgaccggcggggtgaccctcttcttcctgagcgggaaggggctgggcaagacctccatcgggctcctgtgcgtcatggccagctccgccctgctctggatggcgagcgtggagccccactggatcgccgcctccatcatcctggagttcttcctgatggtgctcctgatcccggagcccgaccggcagcgcacgccccaggacaaccagctggcctacgtcgtgatcggcctcctgttcatgatcctgacggtggccgcgaacgagatggggctcctggagaccaccaagaaggacctgggcatcgggcacgtcgccgccgagaaccaccaccacgccaccatgctcgacgtggacctgcggccggccagcgcgtggacgctgtacgccgtggccaccaccgtcatcacccccatgatgcgccacacgatcgagaacaccaccgccaacatctccctcaccgccatcgcgaaccaggccgccatcctgatgggcctggacaagggctggcccatcagcaagatggacatcggggtgcccctcctggccctgggctgctactcccaggtgaacccgctcacgctgaccgccaccgtcctgatgctcgtggcgcactacgccatcatcgggcccggcctgcaggccaaggccacccgggaggcgcagaagcgcacggccgccgggatcatgaagaaccccaccgtggacggcatcgtcaccatcgacctggaccccgtggtgtacgacgccaagttcgagaagcagctcggccagatcatgctgctgatcctctgcaccagccagatcctgctgatgcgcacgacctgggccctctgcgagtccatcaccctggcgaccgggccgctgacgaccctctgggagggcagccccgggaagttctggaacaccaccatcgccgtctccatggccaacatcttccggggcagctacctggccggcgccgggctggcgttctccctcatgaagtccctgggcgggggccgccgggggacgggcgcccagggcgagaccctgggggagaagtggaagcgccagctcaaccagctgtccaagagcgagttcaacacctacaagaagtccggcatcatggaggtggaccggtccgaggccaaggaggggctgaagcgcggcgagaccacgaagcacgccgtgagccgggggaccgccaagctgcgctggttcgtcgagcggaacctcgtgaagcccgagggcaaggtgatcgacctgggctgcgggcgcggcgggtggtcctactactgcgcgggcctgaagaaggtcaccgaggtgaaggggtacaccaagggcggccccgggcacgaggagccgatccccatggccacctacggctggaacctcgtgaagctgcacagcgggaaggacgtcttcttcacgccgcccgagaagtgcgacaccctgctctgcgacatcggcgagtccagcccgaaccccaccatcgaggaggggcggaccctgcgcgtgctgaagatggtggagccctggctccggggcaaccagttctgcatcaagatcctgaacccctacatgccgtccgtcgtggagacgctggagcagatgcagcgcaagcacggcgggatgctcgtgcggaaccccctgagccgcaactccacccacgagatgtactgggtcagctgcggcaccgggaacatcgtgtccgccgtgaacatgaccagccggatgctgctcaaccgcttcacgatggcccaccggaagcccacctacgagcgcgacgtcgacctgggcgcgggcacccgccacgtggccgtggagcccgaggtcgccaacctggacatcatcgggcagcggatcgagaacatcaagaacgagcacaagtccacctggcactacgacgaggacaacccgtacaagacgtgggcctaccacggcagctacgaggtgaagccctccgggagcgcctccagcatggtgaacggcgtcgtgcgcctcctgaccaagccctgggacgtcatccccatggtgacccagatcgcgatgaccgacacgaccccgttcgggcagcagcgggtgttcaaggagaaggtcgacacccgcacgccccgggccaagcgcggcacggcccagatcatggaggtgaccgccaagtggctgtgggacttcctctcccggaacaagaagccccgcatctgcacccgggaggagttcacccgcaaggtgcggagcaacgccgcgatcggcgccgtcttcgtggacgagaaccagtggaacagcgccaaggaggccgtggaggacgagcgcttctgggacctggtccaccgggagcgcgagctgcacaagcaggggaagtgcgccacgtgcgtgtacaacatgatgggcaagcgggagaagaagctcggggagttcggcaaggcgaaggggtcccgcgccatctggtacatgtggctgggcgcccggttcctggagttcgaggccctcggcttcatgaacgaggaccactggttcagccgcgagaactccctgagcggggtggagggcgaggggctgcacaagctcggctacatcctgcgggacatctccaagatccccggcgggaacatgtacgcggacgacaccgccgggtgggacacccgcatcaccgaggacgacctgcagaacgaggccaagatcacggacatcatggagcccgagcacgccctcctggccaccagcatcttcaagctgacctaccagaacaaggtcgtgcgggtgcagcgccccgcgaagtccgggaccgtcatggacgtgatcagccgccgggaccagcgcggctccggccaggtgggcacgtacggcctcaacaccttcaccaacatggaggtccagctgatccggcagatggagagcgaggggatcttctcccccagcgagctggagaccccgaacctcgccaagcgcgtgctggactggctggagaagcacggcgccgagcggctcaagcgcatggccatctccggggacgactgcgtggtcaagcccatcgacgaccggttcgccacggcgctgaccgccctgaacgacatgggcaaggtgcgcaaggacatcccccagtgggagcccagcaaggggtggaacgactggcagcaggtcccgttctgctcccaccacttccaccagctcatcatgaaggacggccgggacatcgtcgtgccctgccgcaaccaggacgagctggtgggccgggcccgcgtcagccagggggccggctggtccctgcgggagaccgcctgcctcggcaagagctacgcgcagatgtggcagctgatgtacttccaccgccgggacctgcgcctcgccgccaacgccatctgcagcgccgtgcccgtggactgggtccccacctcccggaccacgtggagcatccacgcgcaccaccagtggatgaccaccgaggacatgctgtccgtgtggaaccgcgtgtggatcgaggagaacccgtggatggaggacaagacccacgtcagctcctgggaggaggtgccctacctgggcaagcgggaggaccagtggtgcgggagcctcatcggcctgacggcccgcgccacctgggccaccaacatccaggtggcgatcaaccaggtccgccggctgatcggcaacgagaactacctcgactacatgacctccatgaagcgcttcaagaacgagagcgaccccgagggggccctgtggtga

SEQ ID NO: 7968 - RNA, 9879 nt, synthetic construct
  misc_feature 1..9879: note = derived and/or modified CDS sequence (opt1) from DENV-1__FJ850093__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacccacctggccctcatggccacgttcaagatgcgcccgatgttcgccgtggggctgctgttccggcgcctcaccagccgggaggtgctgctgctcaccatcgggctgtccctgatggccagcatggagctccccaactccctggaggagctgggggacggcctcgcgatgggcatcatgatgctgaagctgctcaccgagttccagccccaccagctgtggacgaccctgctcagcctgaccttcgtcaagaccacgctgtccctcgactacgcctggaagaccaccgccatgatcctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcacgatgaagatcaaggacgaggagcgggacgacaccctcaccatcctgctgaaggccaccctcctggccgtgtccggggtgtaccccatgagcatccccgcgacgctgttcgtctggtacttctggcagaagaagaagcagcgctccggcgtgctctgggacacccccagcccgcccgaggtggagcgggccgtcctggacgacggcatctaccgcatcctgcagcgggggctgctcggccgctcccaggtgggggtgggcgtcttccaggacggggtgttccacaccatgtggcacgtgacccggggcgccgtcctgatgtaccagggcaagcgcctggagcccagctgggcctccgtgaagaaggacctcatcagctacgggggcgggtggcggttccagggctcctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggaccagcggctccccgatcgtgaaccgcgagggcaagatcgtggggctgtacggcaacggggtcgtgaccaccagcggcacgtacgtgtccgccatcgcccaggccaaggcgagccaggaggggcccctccccgagatcgaggacgaggtcttcaagaagcggaacctgaccatcatggacctgcacccgggcagcggcaagacccgccggtacctccccgccatcgtgcgcgaggccatcaagcggaagctgcgcaccctgatcctcgcccccacgcgcgtggtcgcgtccgagatggccgaggccctgaaggggatgcccatccggtaccagaccaccgccgtcaagagcgagaccacgggccgcgagatcgtggacctgatgtgccacgccaccttcaccatgcggctcctgtccccggtccgcgtgcccaactacaacatgatcatcatggacgaggcgcacttcaccgaccccgccagcatcgccgcccgggggtacatctccacgcgcgtgggcatgggggaggccgcggccatcttcatgaccgccacgccgcccggcagcgtcgaggccttcccccagtccaacgccgtgatccaggacgaggagcgggacatccccgagcgcagctggaactccggctacgactggatcaccgacttccccgggaagacggtgtggttcgtccccagcatcaagtccggcaacgacatcgcgaactgcctgcggaagaacgggaagcgcgtgatccagctcagccggaagaccttcgacaccgagtaccagaagaccaagaacaacgactgggactacgtggtcacgaccgacatctccgagatgggcgccaacttccgcgccgaccgggtgatcgacccccgccggtgcctgaagcccgtgatcctgaaggacgggcccgagcgcgtcatcctcgccggcccgatgcccgtgaccgtggcgagcgccgcccagcggcgcggccggatcgggcgcaaccagaacaaggagggcgaccagtacgtctacatggggcagcccctgaacaacgacgaggaccacgcccactggaccgaggccaagatgctgctcgacaacatcaacacgcccgagggcatcatcccggcgctgttcgagcccgagcgcgagaagtccgccgccatcgacggggagtaccggctgcgcggcgaggcccggaagaccttcgtggagctcatgcgccggggcgacctgcccgtctggctgagctacaaggtggcctccgaggggttccagtacagcgaccgccggtggtgcttcgacggcgagcgcaacaaccaggtgctcgaggagaacatggacgtcgagatctggaccaaggagggggagcggaagaagctgcgcccccggtggctggacgcgcgcacctactccgacccgctcgccctgcgggagttcaaggagttcgccgccggccgccggagcgtgagcggcgacctgatcctcgagatcgggaagctgccccagcacctgaccctccgcgcccagaacgcgctggacaacctggtgatgctccacaactccgagcagggcgggaaggcctaccggcacgccatggaggagctgcccgacacgatcgagaccctgatgctcctggccctgatcgcggtcctcaccggcggggtgaccctgttcttcctgagcggcaagggcctcgggaagacgtccatcggcctgctgtgcgtgaccgccagctccgccctcctgtggatggccagcgtcgagccccactggatcgccgcgtccatcatcctggagttcttcctcatggtgctgctgatcccggagcccgaccgccagcggacgccccaggacaaccagctcgcctacgtggtcatcgggctgctgttcatgatcctcaccgtggccgccaacgagatgggcctgctggagacgaccaagaaggacctcgggatcggctacgtggccgcggagaaccaccagcacgccaccatgctggacgtcgacctgcgcccggccagcgcctggaccctctacgccgtggcgacgaccgtgatcacccccatgatgcggcacaccatcgagaacacgaccgccaacatctccctgaccgccatcgccaaccaggccgcgatcctgatgggcctcgacaaggggtggcccatcagcaagatggacatcggcgtccccctgctggccctcgggtgctactcccaggtgaacccgctgaccctgacggccgccgtgctcatgctggtcgcgcactacgccatcatcggccccgggctgcaggccaaggccacccgcgaggcccagaagcgcaccgcggccggcatcatgaagaaccccaccgtggacggcatcgtggccatcgacctcgaccccgtcgtgtacgacgccaagttcgagaagcagctggggcagatcatgctgctcatcctgtgcacgagccagatcctgctcatgcggaccacctgggccctgtgcgagtccatcaccctggcgacgggcccgctcaccaccctgtgggaggggagccccggcaagttctggaacaccacgatcgccgtgtccatggccaacatcttccgcggcagctacctggccggggccggcctcgcgttctccctgatgaagtccctcgggggcgggcggcgcgggaccggcgcccagggggagaccctcggcgagaagtggaagcggcagctgaaccagctgtccaagagcgagttcaacacctacaagcgcagcgggatcatggaggtcgaccggtccgaggccaaggagggcctcaagcgcggggagacgaccaagcacgccgtgagccggggcaccgcgaagctgcgctggttcgtggagcggaacctggtcaagcccgagggcaaggtgatcgacctggggtgcggccgcgggggctggtcctactactgcgccgggctcaagcgggtgaccgaggtcaagggctacaccaagggcgggcccggccacgaggagccgatccccatggccacgtacgggtggaacctggtgaagctgcacagcggcaaggacgtgttcttcatgccgcccgagaagtgcgacaccctcctgtgcgacatcggggagtccagcccgaaccccaccatcgaggagggccgcaccctgcgggtcctcaagatggtggagccctggctgaagggcaaccagttctgcatcaagatcctgaacccctacatgccgtccgtggtcgagacgctcgagcagatgcagcgcaagcacgggggcatgctggtgcggaaccccctgagccgcaactccacccacgagatgtactgggtgagctgcgggaccggcaacatcgtctccgccgtgaacatgaccagccggatgctcctgaaccgcttcacgatggcccaccgcaagcccacctacgagcgggacgtggacctgggcgcggggacccgccacgtcgccgtggagcccgaggtggccaacctcgacatcatcggccagcggatcgagaacatcaagaacgagcacaagtccacctggcactacgacgaggacaacccgtacaagacgtgggcctaccacgggagctacgaggtcaagccctccggcagcgcctccagcatggtgaacggggtggtccgcctgctgaccaagccctgggacgtgatccccatggtcacccagatcgcgatgaccgacacgaccccgttcggccagcagcgggtgttcaaggagaaggtggacacccgcacgccccgggccaagcgcggcacgacccagatcatggaggtcaccgccaagtggctctgggggttcctgtcccggaacaagaagccccgcatctgcacccgggaggagttcacgcgcaaggtgcggagcaacgccgccatcggcgcggtgttcgtcgacgagaaccagtggaacagcgccaaggaggccgtggaggacgagcgcttctgggacctggtgcaccgggagcgcgagctccacaagcaggggaagtgcgcgacctgcgtctacaacatgatgggcaagcgggagaagaagctgggggagttcggcaaggcgaagggctcccgcgccatctggtacatgtggctgggggcccggttcctcgagttcgaggccctgggcttcatgaacgaggaccactggttcagccgcgagaactccctgagcggggtggagggcgaggggctccacaagctgggctacatcctgcgggacatctccaagatcccgggcgggaacatgtacgccgacgacaccgcgggctgggacacccgcatcacggaggacgacctccagaacgaggccaagatcaccgacatcatggagcccgagcacgccctgctggccaccagcatcttcaagctcacctaccagaacaaggtggtccgcgtgcagcggcccgccaagaacgggacggtgatggacgtcatctcccgccgggaccagcgcggcagcggccaggtggggacctacggcctgaacaccttcaccaacatggaggtgcagctgatccggcagatggagtccgaggggatcttcctccccagcgagctggagacgccgaacctggcggagcgcgtcctcgactggctggagaagcacggcgccgagcggctgaagcgcatggccatctccggggacgactgcgtggtgaagcccatcgacgaccggttcgccaccgccctcaccgcgctgaacgacatgggcaaggtccgcaaggacatcccccagtgggagcccagcaagggctggaacgactggcagcaggtcccgttctgctcccaccacttccaccagctgatcatgaaggacgggcgggagatcgtggtcccctgccgcaaccaggacgagctcgtgggccgggcccgcgtgagccagggggccggctggtccctgcgggagaccgcctgcctgggcaagagctacgcccagatgtggcagctcatgtacttccaccgccgggacctgcgcctggcggccaacgccatctgctccgccgtccccgtggactgggtgcccaccagccggacgacctggagcatccacgcgcaccaccagtggatgaccaccgaggacatgctctccgtctggaaccgcgtgtggatcgaggagaacccgtggatggaggacaagacgcacgtgagctcctgggaggaggtcccctacctgggcaagcgcgaggaccagtggtgcggcagcctgatcgggctcaccgcccgggccacctgggccaccaacatccaggtggccatcaaccaggtgcgccggctgatcggcaacgagaactacctggactacatgacgtccatgaagcgcttcaagaacgagagcgaccccgagggggcgctctggtga

SEQ ID NO: 7969 - RNA, 9879 nt, synthetic construct
  misc_feature 1..9879: note = derived and/or modified CDS sequence (opt1) from DENV-1__GU131863__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctcttcaagaccagcgtgggggtgaacatgtgcaccctgatcgcgatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtcggcctggggctcgagacgcgcaccgagacctggatgagctccgagggcgcctggaagcagatccagaaggtggagacctgggccctgcggcaccccgggttcacggtgatcgccctgttcctcgcccacgcgatcggcaccagcatcacccagaaggggatcatcttcatcctgctgatgctcgtcaccccctccatggccatgcgctgcgtgggcatcggcaaccgggacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccgcaagctgtgcatcgaggcgaagatcagcaacaccaccacggactcccggtgccccacccagggcgaggccaccctggtcgaggagcaggacgccaacttcgtgtgccgccggaccttcgtggaccgcggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccggaccggcctggacttcaacgagatggtgctcctgacgatgaaggagaagtcctggctggtgcacaagcagtggttcctcgacctgccgctgccctggacctccggggccagcaccagccaggagacctggaaccgccaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccggctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttcctcacccaggacgagaagggggtcacccagaacggccgcctgatcacggccaacccgatcgtgaccgacaaggagaagcccgtgaacatcgagaccgagccgcccttcggggagtcctacatcgtcgtgggcgccggcgagaaggccctgaagctcagctggttcaagaaggggtccagcatcggcaagatgttcgaggcgaccgcccgcggggcccgccggatggccatcctgggcgacacggcctgggacttcgggtccatcggcggcctgttcaccagcgtggggaagctcatccaccaggtcttcggcaccgcgtacggggtgctgttctccggcgtgagctggaccatgaagatcgggatcggcatcctgctcacgtggctgggcctgaactcccgcagcacctccctcagcatgacctgcatcgccgtcgggatggtgaccctgtacctgggcgtgatggtccaggccgactccgggtgcgtgatcaactggaagggccgcgagctcaagtgcgggagcggcatcttcgtgacgaacgaggtccacacctggaccgagcagtacaagttccaggccgactccccgaagcggctgagcgccgcgatcggcaaggcctgggaggagggggtgtgcggcatccgcagcgccacccggctggagaacatcatgtggaagcagatctccaacgagctcaactacatcctgctggagaacgacatgaagttcaccgtggtcgtgggggacatcaacggcatcctcgcccaggggaagaagatgatccgcccccagcccatggagcacaagtacagctggaagtcctggggcaaggccaagatcatcggcgcggacatccagaacacgaccttcatcatcgacgggcccgacaccccggagtgccccgacgaccagcgggcctggaacatctgggaggtggaggactacggcttcgggatcttcaccacgaacatctggctgaagctgcgcgacagccacacccagatgtgcgaccaccggctcatgtccgccgccatcaaggacagcaaggcggtccacgccgacatgggctactggatcgagtccgagaagaacgagacctggaagctggcccgcgccagcttcatcgaggtgaagacctgcatctggcccaagtcccacacgctgtggagcaacggcgtgctcgagtccgagatggtcatccccaagatctacgggggcccgatcagccagcacaactaccggcccgggtacttcacccagaccgccggcccctggcacctggggaagctggagctcgacttcgacctgtgcgagggcaccacggtggtggtcgacgagcactgcggctaccgcgggccgtccctgcggaccaccaccgtgacgggcaagatcatccacgagtggtgctgccgcagctgcaccctgccgcccctgcggttccgcggggaggacggctgctggtacgggatggagatccggcccgtgaaggagaaggaggagaacctggtccgctccatggtgagcgcgggctccggcgaggtggacagcttcagcctcgggatcctgtgcgtctccatcctgatcgaggaggtgatgcggagccgctggtcccggaagatgctcatgaccggcaccctggccgtgttcctgctcctgatcatggggcagctgacgtggaacgacctcatccgcctgtgcatcatggtcggcgccaacgccagcgaccgcatggggatgggcaccacctacctggccctcatggcgaccttcaagatgcggccgatgttcgccgtgggcctgctgttccgccggctcacgtcccgcgaggtgctgctgctcaccgtcgggctgagcctggtggcctccgtcgagctccccaacagcctggaggagctgggcgacgggctcgccatgggcatcatgatgctgaagctgctcaccgacttccagccccaccagctgtggaccacgctgctctccctgaccttcatccggaccagcctgtccctcgactacgcctggaagaccatggcgatggccctgagcatcgtgtccctgttccccctctgcctgagcacgacctcccagaagaccacctggctgccggtgctcctgggcagcttcgggtgcaagcccctgacgatgttcctcatcaccgagaacaagatctggggccgcaagtcctggcccatcaacgaggggatcatggccgtcggcatcgtgagcatcctgctgtccagcctcctgaagaacgacgtgcccctggccgggccgctcatcgcgggcggcatgctgatcgcctgctacgtcatcagcgggtccagcgccgacctgtccctcgagaaggccgccgaggtgagctgggaggaggaggcggagcactccggcaccagccacaacatcctggtggaggtccaggacgacgggaccatgaagatcaaggacgaggagcgggacgacaccctgacgatcctcctgaaggccaccctgctcgccgtgtccggcgtgtaccccatgagcatccccgccaccctgttcgtctggtacttctggcagaagaagaagcagcgctccggggtgctgtgggacacccccagcccgcccgaggtggagcgggccgtcctggacgacggcatctaccgcatcctccagcggggcctgctggggcgctcccaggtgggcgtgggggtcttccaggacggcgtgttccacacgatgtggcacgtgacccgcggggcggtcctcatgtaccagggcaagcgcctggagcccagctgggcctccgtgaagaaggacctgatcagctacggcgggggctggcggttccaggggtcctggaacaccggcgaggaggtgcaggtcatcgccgtggagcccgggaagaacccgaagaacgtgcagaccacgcccggcaccttcaagacccccgagggcgaggtcggggccatcgccctcgacttcaagcccggcaccagcgggtccccgatcgtgaaccgcgagggcaagatcgtgggcctgtacgggaacggcgtcgtgacgaccagcgggacctacgtgtccgcgatcgcccaggccaaggccacccaggagggccccctgcccgagatcgaggacgaggtcttcaagaagcggaacctcacgatcatggacctgcacccggggagcggcaagacccgccggtacctgcccgccatcgtgcgcgaggcgatcaagcggaagctccgcaccctgatcctggcccccacccgcgtggtcgccagcgagatggccgaggcgctcaagggcatgcccatccggtaccagacgaccgccgtgaagtccgagcacaccgggcgcgagatcgtggacctgatgtgccacgccaccttcacgatgcggctgctcagcccggtccgcgtgcccaactacaacatgatcatcatggacgaggcccacttcaccgaccccgcctccatcgcggcccggggctacatcagcacccgcgtggggatgggcgaggccgccgccatcttcatgaccgcgacgcccccggggtccgtcgaggccttcccccagagcaacgccgtgatccaggacgaggagcgggacatccccgagcgctcctggaacagcggctacgactggatcaccgacttccccggcaagaccgtgtggttcgtcccgtccatcaagagcgggaacgacatcgccaactgcctgcggaagaacggcaagcgcgtgatccagctgtcccggaagaccttcgacacggagtaccagaagaccaagaacaacgactgggactacgtggtcaccaccgacatcagcgagatgggggccaacttccgcgcggaccgggtgatcgacccccgccggtgcctcaagcccgtgatcctgaaggagggccccgagcgcgtcatcctggccgggccgatgcccgtgacggtcgcctccgccgcgcagcggcgcggccggatcggccgcaaccagaacaaggagggggaccagtacatctacatgggccagcccctcaacaacgacgaggaccacgcccactggaccgaggccaagatgctgctggacaacatcaacacccccgaggggatcatcccggccctcttcgagcccgagcgcgagaagtccgccgcgatcgacggcgagtaccggctgcgcggggaggcccggaagaccttcgtggagctgatgcgccggggcgacctccccgtgtggctgtcctacaaggtcgccagcgagggcttccagtactccgaccgccggtggtgcttcgacggggagcgcaacaaccaggtgctggaggagaacatggacgtggagatctggacgaaggagggcgagcggaagaagctccgcccccggtggctggacgcccgcacctacagcgacccgctggccctccgggagttcaaggagttcgcggccgggcgccggtccgtcagcggcgacctgatcctggagatcggcaagctcccccagcacctgaccctgcgcgcccagaacgccctcgacaacctggtgatgctgcacaacagcgagcagggcgggaaggcctaccggcacgcgatggaggagctccccgacaccatcgagaccctgatgctgctcgccctgatcgccgtgctgaccggcggggtcaccctcttcttcctgtccgggaaggggctgggcaagaccagcatcgggctcctgtgcgtgatggcctccagcgcgctgctctggatggcctccgtggagccccactggatcgccgccagcatcatcctggagttcttcctgatggtcctcctgatcccggagcccgaccgccagcggacgccccaggacaaccagctggcctacgtggtgatcggcctcctgttcatgatcctgacggtcgcggccaacgagatggggctcctggagaccaccaagaaggacctgggcatcgggcacgtggccgtggagaaccaccaccacgccaccatgctcgacgtcgacctgcgcccggcctccgcgtggacgctgtacgccgtggccaccaccgtgatcacccccatgatgcggcacacgatcgagaacaccaccgccaacatcagcctcaccgccatcgcgaaccaggccgccatcctgatgggcctggacaagggctggcccatctccaagatggacatcggggtccccctcctggccctgggctgctacagccaggtgaacccgctcacgctgaccgccgcggtgctgatgctcgtcgcccactacgccatcatcgggcccggcctgcaggccaaggcgacccgcgaggcccagaagcgcaccgccgccgggatcatgaagaaccccacggtggacggcatcgtgaccatcgacctggaccccgtcgtgtacgacgccaagttcgagaagcagctcggccagatcatgctgctgatcctctgcacctcccagatcctgctgatgcggaccacgtgggcgctctgcgagagcatcaccctggccaccgggccgctgaccacgctctgggagggctcccccgggaagttctggaacaccaccatcgccgtgagcatggccaacatcttccgcggctcctacctggccggcgcggggctggccttcagcctcatgaagtccctgggcgggggccggcgcgggaccggcgcccagggcgagacgctgggggagaagtggaagcggcagctcaaccagctgagcaagtccgagttcaacacctacaagaagtccggcatcatggaggtcgaccgcagcgaggccaaggaggggctgaagcggggcgagaccaccaagcacgccgtgtcccgcgggacggcgaagctgcggtggttcgtggagcgcaacctcgtcaagcccgagggcaaggtgatcgacctgggctgcgggcggggcgggtggagctactactgcgccggcctgaagaaggtgaccgaggtcaaggggtacaccaagggcggccccgggcacgaggagccgatccccatggccacctacggctggaacctcgtgaagctgcactccgggaaggacgtgttcttcacgccgcccgagaagtgcgacacgctgctctgcgacatcggcgagagctccccgaaccccaccatcgaggaggggcgcaccctgcgggtcctgaagatggtggagccctggctccgcggcaaccagttctgcatcaagatcctgaacccctacatgccgagcgtggtcgagaccctggagcagatgcagcggaagcacggcgggatgctcgtgcgcaaccccctgtcccggaacagcacgcacgagatgtactgggtgtcctgcggcaccgggaacatcgtcagcgccgtgaacatgacctcccgcatgctgctcaaccggttcaccatggcgcaccgcaagcccacgtacgagcgcgacgtggacctgggcgccggcacccggcacgtcgccgtggagcccgaggtggccaacctggacatcatcgggcagcgcatcgagaacatcaagaacgagcacaagagcacctggcactacgacgaggacaacccgtacaagacctgggcctaccacggctcctacgaggtcaagcccagcgggtccgcgagctccatggtgaacggcgtcgtgcggctcctgacgaagccctgggacgtgatccccatggtcacccagatcgccatgaccgacaccacgccgttcgggcagcagcgcgtgttcaaggagaaggtggacacccggacgccccgggccaagcggggcaccgcccagatcatggaggtcacggccaagtggctgtggggcttcctcagccgcaacaagaagccccggatctgcacccgcgaggagttcacccggaaggtgcgctccaacgcggccatcggggccgtgttcgtcgacgagaaccagtggaacagcgccaaggaggccgtggaggacgagcggttctgggacctggtgcaccgcgagcgggagctgcacaagcagggcaagtgcgcgacctgcgtctacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaagatcccgggcggcaacatgtacgccgacgacacggccgggtgggacacccggatcaccgaggacgacctgcagaacgaggccaagatcaccgacatcatggagcccgagcacgccctcctggcgacgtccatcttcaagctgacctaccagaacaaggtggtccgcgtgcagcgccccgccaagagcggcaccgtgatggacgtcatctcccggcgcgaccagcgggggagcggccaggtgggcacctacgggctcaacacgttcaccaacatggaggtgcagctgatccgccagatggagtccgagggcatcttcagcccctccgagctggagaccccgaacctcgccaagaaggtcctggactggctggagaagcacggggccgagcggctcaagcgcatggccatcagcggcgacgactgcgtggtgaagcccatcgacgaccggttcgcgaccgccctgacggccctgaacgacatggggaaggtccgcaaggacatcccccagtgggagccctccaagggctggaacgactggcagcaggtcccgttctgcagccaccacttccaccagctcatcatgaaggacggccgggagatcgtggtcccctgccgcaaccaggacgagctggtggggcgggcccgcgtgtcccagggcgccgggtggagcctgcgggagaccgcgtgcctcggcaagtcctacgcccagatgtggcagctgatgtacttccaccgccgggacctgcgcctcgccgccaacgccatctgcagcgcggtccccgtggactgggtgcccaccagccggaccacctggtccatccacgcccaccaccagtggatgacgaccgaggacatgctgagcgtctggaaccgcgtgtggatcgaggagaacccgtggatggaggacaagacccacgtgtccagctgggaggaggtcccctacctggggaagcgggaggaccagtggtgcggctccctcatcggcctgaccgcccgcgccacgtgggcgaccaacatccaggtggccatcaaccaggtgcgccggctgatcgggaacgagaactacctcgactacatgaccagcatgaagcgcttcaagaacgagtccgaccccgagggcgccctgtggtga

SEQ ID NO: 7970 - RNA, 9879 nt, synthetic construct
  misc_feature 1..9879: note = derived and/or modified CDS sequence (opt1) from DENV-1__GQ868559__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacctacctggccctcatggccacgttcaagatgcgcccgatgttcgccgtggggctgctgttccggcgcctcaccagccgggaggtgctgctgctcaccatcgggctgtccctggtcgccagcgtggagctccccaactccctggaggagctgggggacggcctcgcgatgggcatcatgatgctgaagctgctcaccgagttccagccccaccagctgtggacgaccctgctcagcctgaccttcgtcaagaccacgctgtccctcgactacgcctggaagaccaccgccatggtgctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcacgatgaagatcaaggacgaggagcgggacgacaccctcaccatcctgctgaaggccaccctcctggccgtgtccggggtgtaccccatgagcatccccgcgacgctgttcgtctggtacttctggcagaagaagaagcagcgctccggcgtgctctgggacacccccagcccgcccgaggtggagcgggccgtcctggacgacggcatctaccgcatcctgcagcgggggctgctcggccgctcccaggtgggggtgggcgtcttccaggacggggtgttccacaccatgtggcacgtgacccggggcgccgtcctgatgtaccagggcaagcgcctggagcccagctgggcctccgtgaagaaggacctcatcagctacgggggcgggtggcggttccagggctcctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggaccagcggctccccgatcgtgaaccgcgagggcaagatcgtggggctgtacggcaacggggtcgtgaccaccagcggcacgtacgtgtccgccatcgcccaggccaaggcgagccaggaggggcccctccccgagatcgaggacgaggtcttcaagaagcggaacctgaccatcatggacctgcacccgggcagcggcaagacccgccggtacctccccgccatcgtgcgcgaggccatcaagcggaagctgcgcaccctgatcctcgcccccacgcgcgtggtcgcgtccgagatggccgaggccctgaaggggatgcccatccggtaccagaccaccgccgtcaagagcgagcacaccggccgcgagatcgtggacctgatgtgccacgccacgttcaccatgcggctcctgtccccggtccgcgtgcccaactacaacatgatcatcatggacgaggcgcacttcaccgaccccgccagcatcgccgcccgggggtacatctccacccgcgtgggcatgggggaggccgcggccatcttcatgacggccacgccgcccggcagcgtcgaggccttcccccagtccaacgccgtgatccaggacgaggagcgggacatccccgagcgcagctggaactccggctacgactggatcaccgacttccccgggaagaccgtgtggttcgtccccagcatcaagtccggcaacgacatcgcgaactgcctgcggaagaacgggaagcgcgtgatccagctcagccggaagacgttcgacaccgagtaccagaagaccaagaacaacgactgggactacgtggtcaccacggacatctccgagatgggcgccaacttccgcgccgaccgggtgatcgacccccgccggtgcctgaagcccgtgatcctgaaggacgggcccgagcgcgtcatcctcgccggcccgatgcccgtgaccgtcgcgagcgccgcccagcggcgcggccggatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagacgttcgtggagctcatgcgccggggcgacctgcccgtctggctgagctacaaggtggcctccgaggggttccagtacagcgaccgccggtggtgcttcgacggcgagcgcaacaaccaggtgctcgaggagaacatggacgtcgagatctggaccaaggagggggagcggaagaagctgcgcccccggtggctggacgcgcgcacctactccgacccgctcgccctgcgggagttcaaggagttcgccgccggccgccggagcgtgagcggcgacctgatcctcgagatcgggaagctgccccagcacctgaccctccgcgcccagaacgcgctggacaacctggtgatgctccacaactccgagcagggcgggaaggcctaccggcacgccatggaggagctgcccgacaccatcgagacgctgatgctcctggccctgatcgcggtcctcaccggcggggtgaccctgttcttcctgagcggcaagggcctcgggaagacctccatcggcctgctgtgcgtgacggccagctccgccctcctgtggatggccagcgtcgagccccactggatcgccgcgtccatcatcctggagttcttcctcatggtgctgctgatcccggagcccgaccgccagcggacgccccaggacaaccagctcgcctacgtggtcatcgggctgctgttcatgatcctcaccgtggccgccaacgagatgggcctgctggagaccacgaagaaggacctcgggatcggctacgtggccgcggagaaccaccagcacgccaccatgctggacgtcgacctgcgcccggccagcgcctggaccctctacgccgtggcgaccacggtgatcacccccatgatgcggcacaccatcgagaacaccacggccaacatctccctgaccgccatcgccaaccaggccgcgatcctgatgggcctcgacaaggggtggcccatcagcaagatggacatcggcgtccccctgctggccctcgggtgctactcccaggtgaacccgctgaccctgaccgccgccgtgctcatgctggtcgcgcactacgccatcatcggccccgggctgcaggccaaggccacgcgcgaggcccagaagcgcaccgcggccggcatcatgaagaaccccaccgtggacggcatcgtggccatcgacctcgaccccgtcgtgtacgacgccaagttcgagaagcagctggggcagatcatgctgctcatcctgtgcaccagccagatcctgctcatgcggacgacctgggccctgtgcgagtccatcaccctggcgaccggcccgctcacgaccctgtgggaggggagccccggcaagttctggaacaccaccatcgccgtgtccatggccaacatcttccgcggcagctacctggccggggccggcctcgcgttctccctgatgaagtccctcgggggcgggcggcgcgggacgggcgcccagggggagaccctcggcgagaagtggaagcggcagctgaaccagctgtccaagagcgagttcaacacctacaagcgcagcgggatcatggaggtcgaccggtccgaggccaaggagggcctcaagcgcggggagaccacgaagcacgccgtgagccggggcaccgcgaagctgcgctggttcgtggagcggaacctggtcaagcccgagggcaaggtgatcgacctggggtgcggccgcgggggctggtcctactactgcgccgggctcaagaaggtgaccgaggtcaagggctacaccaagggcgggcccggccacgaggagccgatccccatggccacctacgggtggaacctggtgaagctgcacagcggcaaggacgtgttcttcatgccgcccgagaagtgcgacacgctcctgtgcgacatcggggagtccagcccgaaccccaccatcgaggagggccggaccctgcgcgtcctcaagatggtggagccctggctgcggggcaaccagttctgcatcaagatcctgaacccctacatgccgtccgtggtcgagaccctcgagcagatgcagcgcaagcacgggggcatgctggtgcggaaccccctgagccgcaactccacgcacgagatgtactgggtgagctgcgggaccggcaacatcgtctccgccgtgaacatgaccagccggatgctcctgaaccgcttcaccatggcccaccgcaagcccacgtacgagcgggacgtggacctgggcgcggggacccgccacgtcgccgtggagcccgaggaggccaacctcgacatcatcggccagcggatcgagaacatcaagaacgagcacaagtccacctggcactacgacgaggacaacccgtacaagacctgggcctaccacgggagctacgaggtgaagccctccggcagcgcctccagcatggtcaacggggtggtccgcctgctgacgaagccctgggacgtgatccccatggtgacccagatcgcgatgaccgacaccacgccgttcggccagcagcgggtcttcaaggagaaggtggacacccgcacgccccgggccaagcgcggcaccacgcagatcatggaggtgaccgccaagtggctctgggggttcctgtcccggaacaagaagccccgcatctgcacccgggaggagttcacccgcaaggtccggagcaacgccgccatcggcgcggtgttcgtggacgagaaccagtggaacagcgccaaggaggccgtcgaggacgagcgcttctgggacctggtgcaccgggagcgcgagctccacaagcaggggaagtgcgccacgtgcgtgtacaacatgatgggcaagcgggagaagaagctgggggagttcggcaaggcgaagggctcccgcgccatctggtacatgtggctgggggcccggttcctcgagttcgaggccctgggcttcatgaacgaggaccactggttcagccgcgagaactccctgagcggggtcgagggcgaggggctccacaagctgggctacatcctgcgggacatctccaagatcccgggcgggaacatgtacgccgacgacaccgcgggctgggacacccgcatcaccgaggacgacctccagaacgaggccaagatcacggacatcatggagcccgagcacgccctgctggccaccagcatcttcaagctcacctaccagaacaaggtggtgcgcgtccagcggcccgccaagaacgggaccgtgatggacgtgatctcccgccgggaccagcgcggcagcggccaggtcgggacgtacggcctgaacaccttcaccaacatggaggtgcagctgatccggcagatggagtccgaggggatcttcctccccagcgagctggagaccccgaacctggcggagcgcgtgctcgactggctggagaagcacggcgccgagcggctgaagcgcatggccatctccggggacgactgcgtcgtgaagcccatcgacgaccggttcgccacggccctcaccgcgctgaacgacatgggcaaggtgcgcaaggacatcccccagtgggagcccagcaagggctggaacgactggcagcaggtcccgttctgctcccaccacttccaccagctgatcatgaaggacgggcgggagatcgtggtgccctgccgcaaccaggacgagctcgtcggccgggcccgcgtgagccagggggccggctggtccctgcgggagaccgcctgcctgggcaagagctacgcccagatgtggcagctcatgtacttccaccgccgggacctgcgcctggcggccaacgccatctgctccgccgtgcccgtcgactgggtgcccaccagccggaccacgtggagcatccacgcgcaccaccagtggatgaccaccgaggacatgctctccgtgtggaaccgcgtctggatcgaggagaacccgtggatggaggacaagacccacgtgagctcctgggaggaggtgccctacctgggcaagcgcgaggaccagtggtgcggcagcctgatcgggctcacggcccgggccacctgggccaccaacatccaggtcgccatcaaccaggtgcgccggctgatcggcaacgagaactacctggactacatgacctccatgaagcgcttcaagaacgagagcgaccccgagggggcgctctggtga

SEQ ID NO: 7971 - RNA, 9879 nt, synthetic construct
  misc_feature 1..9879: note = derived and/or modified CDS sequence (opt1) from DENV-1__GQ868560__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacctacctggccctcatggccacgttcaagatgcgcccgatgttcgccgtggggctgctgttccggcgcctcaccagccgggaggtgctgctgctcaccatcgggctgtccctggtcgccagcgtggagctccccaactccctggaggagctgggggacggcctcgcgatgggcatcatgatgctgaagctgctcaccgagttccagccccaccagctgtggacgaccctgctcagcctgaccttcgtcaagaccacgctgtccctcgactacgcctggaagaccaccgccatggtgctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcacgatgaagatcaaggacgaggagcgggacgacaccctcaccatcctgctgaaggccaccctcctggccgtgtccggggtgtaccccatgagcatccccgcgacgctgttcgtctggtacttctggcagaagaagaagcagcgctccggcgtgctctgggacacccccagcccgcccgaggtggagcgggccgtcctggacgacggcatctaccgcatcctgcagcgggggctgctcggccgctcccaggtgggggtgggcgtcttccaggacggggtgttccacaccatgtggcacgtgacccggggcgccgtcctgatgtaccagggcaagcgcctggagcccagctgggcctccatcaagaaggacctcatcagctacgggggcgggtggcggttccagggctcctggaacacgggggaggaggtccaggtgatcgccgtcgagcccggcaagaacccgaagaacgtgcagaccacccccggcaccttcaagacgcccgagggggaggtgggcgcgatcgccctggacttcaagcccgggaccagcggctccccgatcgtcaaccgcgagggcaagatcgtggggctgtacggcaacggggtggtcaccaccagcggcacgtacgtgtccgccatcgcccaggccaaggcgagccaggaggggcccctccccgagatcgaggacgaggtgttcaagaagcggaacctgaccatcatggacctgcacccgggcagcggcaagacccgccggtacctccccgccatcgtccgcgaggccatcaagcggaagctgcgcaccctgatcctcgcccccacgcgcgtggtggcgtccgagatggccgaggccctgaaggggatgcccatccggtaccagaccaccgccgtcaagagcgagcacaccggccgcgagatcgtggacctgatgtgccacgccacgttcaccatgcggctcctgtccccggtgcgcgtccccaactacaacatgatcatcatggacgaggcgcacttcaccgaccccgccagcatcgccgcccgggggtacatctccacccgcgtgggcatgggggaggccgcggccatcttcatgacggccacgccgcccggcagcgtggaggccttcccccagtccaacgccgtcatccaggacgaggagcgggacatccccgagcgcagctggaactccggctacgactggatcaccgacttccccgggaagaccgtgtggttcgtgcccagcatcaagtccggcaacgacatcgcgaactgcctgcggaagaacgggaagcgcgtcatccagctcagccggaagacgttcgacaccgagtaccagaagaccaagaacaacgactgggactacgtggtgaccacggacatctccgagatgggcgccaacttccgcgccgaccgggtcatcgacccccgccggtgcctgaagcccgtgatcctgaaggacgggcccgagcgcgtgatcctcgccggcccgatgcccgtcaccgtggcgagcgccgcccagcggcgcggccggatcgggcgcaaccagaacaaggagggcgaccagtacgtctacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagacgttcgtggagctcatgcgccggggcgacctgcccgtgtggctgagctacaaggtcgcctccgaggggttccagtacagcgaccgccggtggtgcttcgacggcgagcgcaacaaccaggtgctcgaggagaacatggacgtggagatctggaccaaggagggggagcggaagaagctgcgcccccggtggctggacgcgcgcacctactccgacccgctcgccctgcgggagttcaaggagttcgccgccggccgccggagcgtcagcggcgacctgatcctcgagatcgggaagctgccccagcacctgaccctccgcgcccagaacgcgctggacaacctggtgatgctccacaactccgagcagggcgggaaggcctaccggcacgccatggaggagctgcccgacaccatcgagacgctgatgctcctggccctgatcgcggtgctcaccggcggggtcaccctgttcttcctgagcggcaagggcctcgggaagacctccatcggcctgctgtgcgtgacggccagctccgccctcctgtggatggccagcgtggagccccactggatcgccgcgtccatcatcctggagttcttcctcatggtcctgctgatcccggagcccgaccgccagcggacgccccaggacaaccagctcgcctacgtggtgatcgggctgctgttcatgatcctcaccgtcgccgccaacgagatgggcctgctggagaccacgaagaaggacctcgggatcggctacgtggccgcggagaaccaccagcacgccaccatgctggacgtggacctgcgcccggccagcgcctggaccctctacgccgtcgcgaccacggtgatcacccccatgatgcggcacaccatcgagaacaccacggccaacatctccctgaccgccatcgccaaccaggccgcgatcctgatgggcctcgacaaggggtggcccatcagcaagatggacatcggcgtgcccctgctggccctcgggtgctactcccaggtcaacccgctgaccctgaccgccgccgtgctcatgctggtggcgcactacgccatcatcggccccgggctgcaggccaaggccacgcgcgaggcccagaagcgcaccgcggccggcatcatgaagaaccccaccgtcgacggcatcgtggccatcgacctcgaccccgtggtctacgacgccaagttcgagaagcagctggggcagatcatgctgctcatcctgtgcaccagccagatcctgctcatgcggacgacctgggccctgtgcgagtccatcaccctggcgaccggcccgctcacgaccctgtgggaggggagccccggcaagttctggaacaccaccatcgccgtgtccatggccaacatcttccgcggcagctacctggccggggccggcctcgcgttctccctgatgaagtccctcgggggcgggcggcgcgggacgggcgcccagggggagaccctcggcgagaagtggaagcggcagctgaaccagctgtccaagagcgagttcaacacctacaagcgcagcgggatcatggaggtggaccggtccgaggccaaggagggcctcaagcgcggggagaccacgaagcacgccgtcagccggggcaccgcgaagctgcgctggttcgtggagcggaacctggtgaagcccgagggcaaggtcatcgacctggggtgcggccgcgggggctggtcctactactgcgccgggctcaagaaggtgaccgaggtgaagggctacaccaagggcgggcccggccacgaggagccgatccccatggccacctacgggtggaacctggtcaagctgcacagcggcaaggacgtgttcttcatgccgcccgagaagtgcgacacgctcctgtgcgacatcggggagtccagcccgaaccccaccatcgaggagggccggaccctgcgcgtgctcaagatggtcgagccctggctgcggggcaaccagttctgcatcaagatcctgaacccctacatgccgtccgtggtggagaccctcgagcagatgcagcgcaagcacgggggcatgctggtccggaaccccctgagccgcaactccacgcacgagatgtactgggtgagctgcgggaccggcaacatcgtgtccgccgtcaacatgaccagccggatgctcctgaaccgcttcaccatggcccaccgcaagcccacgtacgagcgggacgtggacctgggcgcggggacccgccacgtggccgtcgagcccgaggaggccaacctcgacatcatcggccagcggatcgagaacatcaagaacgagcacaagtccacctggcactacgacgaggacaacccgtacaagacctgggcctaccacgggagctacgaggtgaagccctccggcagcgcctccagcatggtgaacggggtcgtgcgcctgctgacgaagccctgggacgtcatccccatggtgacccagatcgcgatgaccgacaccacgccgttcggccagcagcgggtgttcaaggagaaggtcgacacccgcacgccccgggccaagcgcggcaccacgcagatcatggaggtgaccgccaagtggctctgggggttcctgtcccggaacaagaagccccgcatctgcacccgggaggagttcacccgcaaggtgcggagcaacgccgccatcggcgcggtcttcgtggacgagaaccagtggaacagcgccaaggaggccgtggaggacgagcgcttctgggacctggtccaccgggagcgcgagctccacaagcaggggaagtgcgccacgtgcgtgtacaacatgatgggcaagcgggagaagaagctgggggagttcggcaaggcgaagggctcccgcgccatctggtacatgtggctgggggcccggttcctcgagttcgaggccctgggcttcatgaacgaggaccactggttcagccgcgagaactccctgagcggggtggagggcgaggggctccacaagctgggctacatcctgcgggacatctccaagatcccgggcgggaacatgtacgccgacgacaccgcgggctgggacacccgcatcaccgaggacgacctccagaacgaggccaagatcacggacatcatggagcccgagcacgccctgctggccaccagcatcttcaagctcacctaccagaacaaggtcgtgcgcgtgcagcggcccgccaagaacgggaccgtcatggacgtgatctcccgccgggaccagcgcggcagcggccaggtggggacgtacggcctgaacaccttcaccaacatggaggtccagctgatccggcagatggagtccgaggggatcttcctccccagcgagctggagaccccgaacctggcggagcgcgtgctcgactggctggagaagcacggcgccgagcggctgaagcgcatggccatctccggggacgactgcgtggtcaagcccatcgacgaccggttcgccacggccctcaccgcgctgaacgacatgggcaaggtgcgcaaggacatcccccagtgggagcccagcaagggctggaacgactggcagcaggtcccgttctgctcccaccacttccaccagctgatcatgaaggacgggcgggagatcgtcgtgccctgccgcaaccaggacgagctcgtgggccgggcccgcgtcagccagggggccggctggtccctgcgggagaccgcctgcctgggcaagagctacgcccagatgtggcagctcatgtacttccaccgccgggacctgcgcctggcggccaacgccatctgctccgccgtgcccgtggactgggtccccaccagccggaccacgtggagcatccacgcgcaccaccagtggatgaccaccgaggacatgctctccgtgtggaaccgcgtgtggatcgaggagaacccgtggatggaggacaagacccacgtcagctcctgggaggaggtgccctacctgggcaagcgcgaggaccagtggtgcggcagcctgatcgggctcacggcccgggccacctgggccaccaacatccaggtggccatcaaccaggtccgccggctgatcggcaacgagaactacatcgactacatgacctccatgaagcgcttcaagaacgagagcgaccccgagggggcgctgtggtga

SEQ ID NO: 7972 - RNA, 9879 nt, synthetic construct
  misc_feature 1..9879: note = derived and/or modified CDS sequence (opt1) from DENV-1__GQ868561__SS-prME
  source 1..9879: mol_type = other RNA
agcgtgaccatgctgctcatgctgctgcccaccgcgctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccgcaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagaaggggagctccatcggcaagatgttcgaggccaccgcccgcggggcccggcgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcgcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctgcgggactcctacacccagatgtgcgaccaccgcctcatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctgtggtccaacggggtcctcgagagcgagatgatcatccccaagatctacggcgggccgatctcccagcacaactaccgccccggctacttcacccagaccgccgggccctggcacctgggcaagctggagctcgacttcgacctgtgcgagggcacgaccgtggtggtcgacgagcactgcgggaaccggggcccgagcctgcgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctggtccggagcatggtgtccgccggcagcggggaggtggacagcttctccctcggcatcctgtgcgtcagcatcatgatcgaggaggtgatgcgctcccggtggagccgcaagatgctgatgaccgggacgctcgccgtgttcctgctgctcatcatgggccagctgacctggaacgacctgatccgcctctgcatcatggtcggggccaacgcgtccgaccggatgggcatgggcaccacctacctggccctgatggccacgttcaagatgcgcccgatgttcgccgtggggctcctgttccggcgcctgaccagccgggaggtgctcctgctgaccatcggcctctccctggtcgccagcgtggagctgcccaactccctcgaggagctgggggacggcctggcgatgggcatcatgatgctcaagctgctgaccgagttccagccccaccagctctggacgaccctgctgagcctcaccttcgtcaagaccacgctgtccctggactacgcctggaagaccaccgccatggtgctcagcatcgtgtccctgttccccctgtgcctcagcaccacgtcccagaagaccacctggctgccggtcctgctcgggagcttcggctgcaagcccctgaccatgttcctgatcaccgagaacaagatctgggggcgcaagtcctggcccctcaacgagggcatcatggccatcgggatcgtgagcatcctgctgtccagcctcctgaagaacgacgtgcccctggcgggcccgctcatcgccggcgggatgctgatcgcctgctacgtcatcagcggctccagcgccgacctgtccctcgagaaggccgcggaggtgagctgggagcaggaggccgagcactccggggccagccacaacatcctggtggaggtccaggacgacggcacgatgaagatcaaggacgaggagcgggacgacaccctgaccatcctcctgaaggccaccctgctcgccgtgtccggggtgtaccccatgagcatccccgcgacgctgttcgtctggtacttctggcagaagaagaagcagcgctccggcgtgctgtgggacacccccagcccgcccgaggtggagcgggccgtcctcgacgacggcatctaccgcatcctgcagcgggggctgctgggccgctcccaggtgggggtgggcgtcttccaggacggggtgttccacaccatgtggcacgtgacccggggcgccgtcctcatgtaccagggcaagcgcctggagcccagctgggcctccgtgaagaaggacctgatcagctacgggggcgggtggcggttccagggctcctggaacacgggggaggaggtgcaggtcatcgccgtggagcccggcaagaacccgaagaacgtgcagaccacccccggcaccttcaagacgcccgagggggaggtcggcgcgatcgccctcgacttcaagcccgggaccagcggctccccgatcgtgaaccgcgagggcaagatcgtggggctgtacggcaacggggtcgtgaccaccagcggcacgtacgtgtccgccatcgcccaggccaaggcgagccaggaggggcccctgcccgagatcgaggacgaggtcttcaagaagcggaacctcaccatcatggacctgcacccgggcagcggcaagacccgccggtacctgcccgccatcgtgcgcgaggccatcaagcggaagctccgcaccctgatcctggcccccacgcgcgtggtcgcgtccgagatggccgaggccctcaaggggatgcccatccggtaccagaccaccgccgtcaagagcgagcacaccggccgcgagatcgtggacctgatgtgccacgccacgttcaccatgcggctgctctccccggtccgcgtgcccaactacaacatgatcatcatggacgaggcgcacttcaccgaccccgccagcatcgccgcccgggggtacatctccacccgcgtgggcatgggggaggccgcggccatcttcatgacggccacgccgcccggcagcgtcgaggccttcccccagtccaacgccgtgatccaggacgaggagcgggacatccccgagcgcagctggaactccggctacgactggatcaccgacttccccgggaagaccgtgtggttcgtccccagcatcaagtccggcaacgacatcgcgaactgcctgcggaagaacgggaagcgcgtgatccagctgagccggaagacgttcgacaccgagtaccagaagaccaagaacaacgactgggactacgtggtcaccacggacatctccgagatgggcgccaacttccgcgccgaccgggtgatcgacccccgccggtgcctcaagcccgtgatcctgaaggacgggcccgagcgcgtcatcctggccggcccgatgcccgtgaccgtcgcgagcgccgcccagcggcgcggccggatcgggcgcaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgcgagaagtccgccgccatcgacggggagtaccggctgcgcggcgaggcccggaagacgttcgtggagctgatgcgccggggcgacctccccgtctggctgagctacaaggtggcctccgaggggttccagtacagcgaccgccggtggtgcttcgacggcgagcgcaacaaccaggtgctggaggagaacatggacgtcgagatctggaccaaggagggggagcggaagaagctccgcccccggtggctggacgcgcgcacctactccgacccgctggccctccgggagttcaaggagttcgccgccggccgccggagcgtgagcggcgacctgatcctggagatcgggaagctcccccagcacctgaccctgcgcgcccagaacgcgctcgacaacctggtgatgctgcacaactccgagcagggcgggaaggcctaccggcacgccatggaggagctccccgacaccatcgagacgctgatgctgctcgccctgatcgcggtcctgaccggcggggtgaccctcttcttcctgagcggcaagggcctggggaagacctccatcggcctcctgtgcgtgacggccagctccgccctgctctggatggccagcgtcgagccccactggatcgccgcgtccatcatcctggagttcttcctgatggtgctcctgatcccggagcccgaccgccagcggacgccccaggacaaccagctggcctacgtggtcatcgggctcctgttcatgatcctgaccgtggccgccaacgagatgggcctcctggagaccacgaagaaggacctggggatcggctacgtggccgcggagaaccaccagcacgccaccatgctcgacgtcgacctgcgcccggccagcgcctggaccctgtacgccgtggcgaccacggtgatcacccccatgatgcggcacaccatcgagaacaccacggccaacatctccctcaccgccatcgccaaccaggccgcgatcctgatgggcctggacaaggggtggcccatcagcaagatggacatcggcgtccccctcctggccctggggtgctactcccaggtgaacccgctcaccctgaccgccgccgtgctgatgctcgtcgcgcactacgccatcatcggccccgggctgcaggccaaggccacgcgcgaggcccagaagcgcaccgcggccggcatcatgaagaaccccaccgtggacggcatcgtggccatcgacctggaccccgtcgtgtacgacgccaagttcgagaagcagctcgggcagatcatgctgctgatcctctgcaccagccagatcctgctgatgcggacgacctgggccctctgcgagtccatcaccctggcgaccggcccgctgacgaccctctgggaggggagccccggcaagttctggaacaccaccatcgccgtgtccatggccaacatcttccgcggcagctacctggccggggccggcctggcgttctccctcatgaagtccctcgggggcgggcggcgcggcacgggcgcccagggggagaccctgggcgagaagtggaagcggcagctcaaccagctgtccaagagcgagttcaacacctacaagcgcagcgggatcatggaggtcgaccggtccgaggccaaggagggcctgaagcgcggggagaccacgaagcacgccgtgagccggggcaccgcgaagctccgctggttcgtggagcggaacctggtcaagcccgagggcaaggtgatcgacctggggtgcggccgcgggggctggtcctactactgcgccgggctgaagaaggtgaccgaggtcaagggctacaccaagggcgggcccggccacgaggagccgatccccatggccacctacgggtggaacctcgtgaagctgcacagcggcaaggacgtgttcttcatgccgcccgagaagtgcgacacgctgctctgcgacatcggggagtccagcccgtcccccaccatcgaggagggccggaccctgcgcgtcctgaagatggtggagccctggctccggggcaaccagttctgcatcaagatcctgaacccctacatgccgagcgtggtcgagaccctggagcagatgcagcgcaagcacgggggcatgctcgtgcggaaccccctgtcccgcaacagcacgcacgagatgtactgggtgtcctgcgggaccggcaacatcgtcagcgccgtgaacatgacctcccggatgctgctcaaccgcttcaccatggcccaccgcaagcccacgtacgagcgggacgtggacctgggcgcggggacccgccacgtcgccgtggagcccgaggtggccaacctggacatcatcggccagcggatcgagaacatcaagaacgagcacaagagcacctggcactacgacgaggacaacccgtacaagacctgggcctaccacgggtcctacgaggtcaagcccagcggctccgccagctccatggtgaacggggtcgtgcgcctcctgacgaagccctgggacgtgatccccatggtcacccagatcgcgatgaccgacaccacgccgttcggccagcagcgggtgttcaaggagaaggtggacacccgcacgccccgggccaagcgcggcaccacgcagatcatggaggtcaccgccaagtggctgtgggggttcctcagccggaacaagaagccccgcatctgcacccgggaggagttcacccgcaaggtgcggagcaacgccgccatcggcgcggtgttcgtcgacgagaaccagtggaactccgccaaggaggccgtggaggacgagcgcttctgggacctggtgcaccgggagcgcgagctgcacaagcaggggaagtgcgccacgtgcgtctacaacatgatgggcaagcgggagaagaagctcggggagttcggcaaggcgaagggcagccgcgccatctggtacatgtggctgggggcccggttcctggagttcgaggccctcggcttcatgaacgaggaccactggttctcccgcgagaacagcctgtccggggtggagggcgaggggctgcacaagctcggctacatcctgcgggacatcagcaagatcccgggcgggaacatgtacgccgacgacaccgcgggctgggacacccgcatcaccgaggacgacctgcagaacgaggccaagatcacggacatcatggagcccgagcacgccctcctggccacctccatcttcaagctgacctaccagaccaaggtggtccgcgtgcagcggcccgccaagaacgggacggtgatggacgtcatcagccgccgggaccagcgcggctccggccaggtggggacctacggcctcaacaccttcaccaacatggaggtgcagctgatccggcagatggagagcgaggggatcttcctgccctccgagctcgagacgccgaacctggcggagcgcgtcctggactggctcgagaagcacggcgccgagcggctgaagcgcatggccatcagcggggacgactgcgtggtgaagcccatcgacgaccggttcgccaccgccctgaccgcgctcaacgacatgggcaaggtccgcaaggacatcccccagtgggagccctccaagggctggaacgactggcagcaggtcccgttctgcagccaccacttccaccagctgatcatgaaggacgggcgggagatcgtggtcccctgccgcaaccaggacgagctggtgggccgggcccgcgtgtcccagggggccggctggagcctccgggagaccgcctgcctggggaagtcctacgcccagatgtggcagctgatgtacttccaccgccgggacctccgcctggcggccaacgccatctgcagcgccgtccccgtggactgggtgcccaccagccggacgacctggtccatccacgcgcaccaccagtggatgaccaccgaggacatgctgagcgtctggaaccgcgtgtggatcgaggagaacccgtggatggaggacaagacgcacgtgtccagctgggaggaggtcccctacctcggcaagcgcgaggaccagtggtgcggctccctgatcgggctgaccgcccgggccacctgggccaccaacatccaggtggccatcaaccaggtgcgccggctcatcggcaacgagaactacctggactacatgacgagcatgaagcgcttcaagaacgagtccgaccccgagggggcgctgtggtga

SEQ ID NO: 7973 - RNA, 9879 nt, synthetic construct
  misc_feature 1..9879: note = derived and/or modified CDS sequence (opt1) from DENV-1__GU131948__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgccccacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacctacctggccctcatggccacgttcaagatgcgcccgatgttcgccgtggggctgctgttccggcgcctcaccagccgggagatcctgctgctcaccatcgggctgtccctggtggccagcgtcgagctccccaactccctggaggagctgggggacggcctcgcgatgggcatcatgatgctgaagctgctcaccgagttccagccccaccagctgtggacgaccctgctcagcctgaccttcgtgaagaccacgctgtccctcgactacgcctggaagaccaccgccatggtcctgagcatcgtgtccctgttccccctctgcctgagcaccacgtcccagaagaccacctggctgccggtgctcctggggagcttcggctgcaagcccctgaccatgttcctcatcaccgagaacaagatctgggggcgcaagtcctggcccctgaacgagggcatcatggccatcgggatcgtcagcatcctgctctccagcctgctgaagaacgacgtgcccctcgcgggcccgctgatcgccggcgggatgctgatcgcctgctacgtgatcagcggctccagcgccgacctctccctggagaaggccgcggaggtcagctgggagcaggaggccgagcactccggggccagccacaacatcctggtggaggtgcaggacgacggcacgatgaagatcaaggacgaggagcgggacgacaccctcaccatcctgctgaaggccaccctcctggccgtctccggggtgtaccccatgagcatccccgcgacgctgttcgtgtggtacttctggcagaagaagaagcagcgctccggcgtcctctgggacacccccagcccgcccgaggtggagcgggccgtgctggacgacggcatctaccgcatcctgcagcgggggctgctcggccgctcccaggtcggggtgggcgtgttccaggacggggtcttccacaccatgtggcacgtgacccggggcgccgtgctgatgtaccagggcaagcgcctggagcccagctgggcctccgtcaagaaggacctcatcagctacgggggcgggtggcggttccagggctcctggaacacgggggaggaggtccaggtgatcgccgtcgagcccggcaagaacccgaagaacgtgcagaccacccccggcatcttcaagacccccgagggggaggtgggcgcgatcgccctggacttcaagcccgggacgagcggctccccgatcgtcaaccgcgagggcaagatcgtggggctgtacggcaacggggtggtcaccaccagcggcacctacgtgtccgccatcgcccaggccaaggcgagccaggaggggcccctccccgagatcgaggacgaggtgttcaagaagcggaacctgacgatcatggacctgcacccgggcagcggcaagacccgccggtacctccccgccatcgtccgcgaggccatcaagcggaagctgcgcaccctgatcctcgcccccacccgcgtggtggcgtccgagatggccgaggccctgaaggggatgcccatccggtaccagacgaccgccgtcaagagcgagcacaccggccgcgagatcgtggacctgatgtgccacgccaccttcacgatgcggctcctgtccccggtgcgcgtccccaactacaacatgatcatcatggacgaggcgcacttcaccgaccccgccagcatcgccgcccgggggtacatctccacccgcgtgggcatgggggaggccgcggccatcttcatgaccgccacgcccccgggcagcgtggaggccttcccccagtccaacgccgtcatccaggacgaggagcgggacatccccgagcgcagctggaactccggctacgactggatcaccgacttccccgggaagaccgtgtggttcgtgccgagcatcaagtccggcaacgacatcgcgaactgcctgcggaagaacgggaagcgcgtcatccagctcagccggaagaccttcgacacggagtaccagaagaccaagaacaacgactgggactacgtggtgaccaccgacatctccgagatgggcgccaacttccgcgccgaccgggtcatcgacccccgccggtgcctgaagcccgtgatcctgaaggacgggcccgagcgcgtgatcctcgccggcccgatgcccgtcacggtggcgagcgccgcccagcggcgcggccggatcgggcgcaaccagaacaaggagggcgaccagtacgtctacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagaccttcgtggagctcatgcgccggggcgacctgcccgtgtggctgagctacaaggtcgcctccgaggggttccagtacagcgaccgccggtggtgcttcgacggcgagcgcaacaaccaggtgctcgaggagaacatggacgtggagatctggacgaaggagggggagcggaagaagctgcgcccccggtggctggacgcgcgcacctactccgacccgctcgccctgcgggagttcaaggagttcgccgccggccgccggagcatcagcggcgacctgatcctcgagatcgggaagctgccccagcacctgaccctccgcgcccagaacgcgctggacaacctggtcatgctccacaactccgagcagggcgggaaggcctaccggcacgccatggaggagctgcccgacaccatcgagaccctgatgctcctggccctgatcgcggtgctcacgggcggggtgaccctgttcttcctgagcggcaagggcctcgggaagacctccatcggcctgctgtgcgtcaccgccagctccgccctcctgtggatggccagcgtggagccccactggatcgccgcgtccatcatcctggagttcttcctcatggtgctgctgatcccggagcccgaccgccagcggacgccccaggacaaccagctcgcctacgtcgtgatcgggctgctgttcatgatcctcaccgtggccgccaacgagatgggcctgctggagaccaccaagaaggacctcgggatcggctacgtcgccgcggagaaccaccagcacgccacgatgctggacgtggacctgcgcccggccagcgcctggaccctctacgccgtggcgaccaccgtcatcacgcccatgatgcggcacaccatcgagaacaccaccgccaacatctccctgacggccatcgccaaccaggccgcgatcctgatgggcctcgacaaggggtggcccatcagcaagatggacatcggcgtgcccctgctggccctcgggtgctactcccaggtgaacccgctgaccctgaccgccgccgtcctcatgctggtggcgcactacgccatcatcggccccgggctgcaggccaaggccacccgcgaggcccagaagcgcacggcggccggcatcatgaagaaccccaccgtggacggcatcgtcgccatcgacctcgaccccgtggtgtacgacgccaagttcgagaagcagctggggcagatcatgctgctcatcctgtgcaccagccagatcctgctcatgcggaccacgtgggccctgtgcgagtccatcaccctggcgaccggcccgctcaccacgctgtgggaggggagccccggcaagttctggaacaccaccatcgccgtctccatggccaacatcttccgcggcagctacctggccggggccggcctcgcgttctccctgatgaagtccctcgggggcgggcggcgcgggaccggcgcccagggggagacgctcggcgagaagtggaagcggcagctgaaccagctgtccaagagcgagttcaacacctacaagcgcagcgggatcatggaggtggaccggtccgaggccaaggagggcctcaagcgcggggagaccaccaagcacgccgtgagccggggcacggcgaagctgcgctggttcgtcgagcggaacctggtgaagcccgagggcaaggtgatcgacctggggtgcggccgcgggggctggtcctactactgcgccgggctcaagaaggtcaccgaggtgaagggctacaccaagggcgggcccggccacgaggagccgatccccatggccacctacgggtggaacctggtgaagctgcacagcggcaaggacgtcttcttcatgccgcccgagaagtgcgacaccctcctgtgcgacatcggggagtccagcccgaaccccacgatcgaggagggccggaccctgcgcgtgctcaagatggtggagccctggctgcggggcaaccagttctgcatcaagatcctgaacccctacatgccgtccgtcgtggagaccctcgagcagatgcagcgcaagcacgggggcatgctggtgcggaaccccctgagccgcaactccacccacgagatgtactgggtcagctgcgggacgggcaacatcgtgtccgccgtgaacatgaccagccggatgctcctgaaccgcttcaccatggcccaccgcaagcccacctacgagcgggacgtcgacctgggcgcggggacgcgccacgtggccgtggagcccgaggtcgccaacctcgacatcatcggccagcggatcgagaacatcaagaacgagcacaagtccacctggcactacgacgaggacaacccgtacaagacctgggcctaccacgggagctacgaggtgaagccctccggcagcgcctccagcatggtgaacggggtcgtgcgcctgctgaccaagccctgggacgtcatccccatggtgacgcagatcgcgatgaccgacaccaccccgttcggccagcagcgggtgttcaaggagaaggtcgacacgcgcacgccccgggccaagcgcggcaccacccagatcatggaggtgacggccaagtggctctgggggttcctgtcccggaacaagaagccccgcatctgcacccgggaggagttcacccgcaaggtgcggagcaacgccgccatcggcgcggtcttcgtggacgagaaccagtggaacagcgccaaggaggccgtggaggacgagcgcttctgggacctggtccaccgggagcgcgagctccacaagcaggggaagtgcgcgacctgcgtgtacaacatgatgggcaagcgggagaagaagctgggggagttcggcaaggcgaagggctcccgcgccatctggtacatgtggctgggggcccggttcctcgagttcgaggccctgggcttcatgaacgaggaccactggttcagccgcgagaactccctgagcggggtggagggcgaggggctccacaagctgggctacatcctgcgggacatctccaagatcccgggcgggaacatgtacgccgacgacacggcgggctgggacacccgcatcaccgaggacgacctccagaacgaggccaagatcaccgacatcatggagcccgagcacgccctgctggccacgagcatcttcaagctcacctaccagaacaaggtcgtgcgcgtgcagcggcccgccaagaacgggaccgtcatggacgtgatctcccgccgggaccagcgcggcagcggccaggtggggacctacggcctgaacacgttcaccaacatggaggtccagctgatccggcagatggagtccgaggggatcttcctccccagcgagctggagaccccgaacctggcggagcgcgtgctcgactggctggagaagcacggcgccgagcggctgaagcgcatggccatctccggggacgactgcgtggtcaagcccatcgacgaccggttcgccaccgccctcacggcgctgaacgacatgggcaaggtgcgcaaggacacgccccagtgggagcccagcaagggctggaacgactggcagcaggtcccgttctgctcccaccacttccaccagctgatcatgaaggacgggcgggagatcgtcgtgccctgccgcaaccaggacgagctcgtgggccgggcccgcgtcagccagggggccggctggtccctgcgggagaccgcctgcctgggcaagagctacgcccagatgtggcagctcatgtacttccaccgccgggacctgcgcctggcggccaacgccatctgctccgccgtgcccgtggactgggtccccaccagccggaccacgtggagcatccacgcgcaccaccagtggatgaccaccgaggacatgctctccgtgtggaaccgcgtgtggatcgaggagaacccgtggatggaggacaagacccacgtcagctcctgggaggaggtgccctacctgggcaagcgcgaggaccagtggtgcggcagcctgatcgggctcacggcccgggccacctgggccaccaacatccaggtggccatcaaccaggtccgccggctgatcggcaacgagaactacctggactacatgacctccatgaagcgcttcaagaacgagagcgaccccgagggggcgctctggtga

SEQ ID NO: 7974 - RNA, 9879 nt, synthetic construct
  misc_feature 1..9879: note = derived and/or modified CDS sequence (opt1) from DENV-1__GQ868562__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctcttcggcaaggggagcctgctgacgtgcgccaagttcaagtgcgtgaccaagctcgagggcaagatcgtccagcacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctccgggactcctacacccagatgtgcgaccaccgcctgatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcacgaccgtggtggtcgacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggacgctggccgtgttcctgctcctgatcatgggccagctgacctggaacgacctcatccgcctgtgcatcatggtcggggccaacgcgtccgaccggatgggcatgggcaccacccacctggccctcatggccacgttcaagatgcgcccgatgttcgccgtggggctgctgttccggcgcctcaccagccgggaggtgctgctgctcaccatcgggctgtccctggtcgccagcgtggagctccccaactccctggaggagctgggggacggcctcgcgatgggcatcatgatgctgaagctgctcaccgagttccagccccaccagctgtggacgaccctgctcagcctgaccttcgtcaagaccacgctgtccctcgactacgcctggaagaccaccgccatggtgctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgcgggcccgctgatcgccggcgggatgctgatcgcctgctacgtcatcagcggctccagcgccgacctctccctggagaaggccgcggaggtgagctgggagcaggaggccgagcactccggggccagccacaacatcctggtggaggtccaggacgacggcacgatgaagatcaaggacgaggagcgggacgacaccctcaccatcctgctgaaggccaccctcctggccgtgtccggggtgtaccccatgagcatccccgcgacgctgttcgtctggtacttctggcagaagaagaagcagcgctccggcgtgctctgggacacccccagcccgcccgaggtggagcgggccgtcctggacgacggcatctaccgcatcctgcagcgggggctgctcggccgctcccaggtgggggtgggcgtcttccaggacggggtgttccacaccatgtggcacgtgacccggggcgccgtcctgatgtaccagggcaagcgcctggagcccagctgggcctccgtgaagaaggacctcatcagctacgggggcgggtggcggttccagggctcctggaacacgggggaggaggtgcaggtcatcgccgtggagcccggcaagaacccgaagaacgtgcagaccacccccggcaccttcaagacgcccgagggggaggtcggcgcgatcgccctggacttcaagcccgggaccagcggctccccgatcgtgaaccgcgagggcaagatcgtggggctgtacggcaacggggtcgtgaccaccagcggcacgtacgtgtccgccatcgcccaggccaaggcgagccaggaggggcccctccccgagatcgaggacgaggtcttcaagaagcggaacctgaccatcatggacctgcacccgggcagcggcaagacccgccggtacctccccgccatcgtgcgcgaggccatcaagcggaagctgcgcaccctgatcctcgcccccacgcgcgtggtcgcgtccgagatggccgaggccctgaaggggatgcccatccggtaccagaccaccgccgtcaagagcgagcacaccggccgcgagatcgtggacctgatgtgccacgccacgttcaccatgcggctcctgtccccggtccgcgtgcccaactacaacatgatcatcatggacgaggcgcacttcaccgaccccgccagcatcgccgcccgggggtacatctccacccgcgtgggcatgggggaggccgcggccatcttcatgacggccacgccgcccggcagcgtcgaggccttcccccagtccaacgccgtgatccaggacgaggagcgggacatccccgagcgcagctggaactccggctacgactggatcaccgacttccccgggaagaccgtgtggttcgtccccagcatcaagtccggcaacgacatcgcgaactgcctgcggaagaacgggaagcgcgtgatccagctcagccggaagacgttcgacaccgagtaccagaagaccaagaacaacgactgggactacgtggtcaccacggacatctccgagatgggcgccaacttccgcgccgaccgggtgatcgacccccgccggtgcctgaagcccgtgatcctgaaggacgggcccgagcgcgtcatcctcgccggcccgatgcccgtgaccgtcgcgagcgccgcccagcggcgcggccggatcgggcgcaaccagaacaaggagggcgaccagtacgtgtacatggggcagcccctgaacaacgacgaggaccacgcccactggaccgaggccaagatgctgctcgacaacatcaacacccccgagggcatcatcccggcgctgttcgagcccgagcgcgagaagtccgccgccatcgacggggagtaccggctgcgcggcgaggcccggaagacgttcgtggagctcatgcgccggggcgacctgcccgtctggctgagctacaaggtggcctccgaggggttccagtacagcgaccgccggtggtgcttcgacggcgagcgcaacaaccaggtgctcgaggagaacatggacgtcgagatctggaccaaggagggggagcggaagaagctgcgcccccggtggctggacgcgcgcacctactccgacccgctcgccctgcgggagttcaaggagttcgccgccggccgccggagcgtgagcggcgacctgatcctcgagatcgggaagctgccccagcacctgaccctccgcgcccagaacgcgctggacaacctggtgatgctccacaactccgagcagggcgggaaggcctaccggcacgccatggaggagctgcccgacaccatcgagacgctgatgctcctggccctgatcgcggtcctcaccggcggggccaccctgttcttcctgagcggcaagggcctcgggaagacctccatcggcctgctgtgcgtgacggccagctccgccctcctgtggatggccagcgtggagccccactggatcgcggcctccatcatcctggagttcttcctcatggtcctgctgatcccggagcccgaccgccagcggacgccccaggacaaccagctcgcctacgtggtgatcgggctgctgttcatgatcctcaccgtcgccgccaacgagatgggcctgctggagaccacgaagaaggacctcgggatcggctacgtggcggccgagaaccaccagcacgccaccatgctggacgtggacctgcgcccggccagcgcctggaccctctacgcggtcgccaccacggtgatcacccccatgatgcggcacaccatcgagaacaccacggccaacatctccctgaccgccatcgccaaccaggcggccatcctgatgggcctcgacaaggggtggcccatcagcaagatggacatcggcgtgcccctgctggccctcgggtgctactcccaggtcaacccgctgaccctgaccgccgcggtgctcatgctggtggcccactacgccatcatcggccccgggctgcaggccaaggccacgcgcgaggcgcagaagcgcaccgccgccggcatcatgaagaaccccaccgtcgacggcatcgtggccatcgacctcgaccccgtggtctacgacgccaagttcgagaagcagctggggcagatcatgctgctcatcctgtgcaccagccagatcctgctcatgcggacgacctgggcgctgtgcgagtccatcaccctggccaccggcccgctcacgaccctgtgggaggggagccccggcaagttctggaacaccaccatcgccgtgtccatggccaacatcttccgcggcagctacctggccggggcgggcctcgccttctccctgatgaagtccctcgggggcgggcggcgcgggacgggcgcccagggggagaccctcggcgagaagtggaagcggcagctgaaccagctgtccaagagcgagttcaacacctacaagcgcagcgggatcatggaggtggaccggtccgaggccaaggagggcctcaagcgcggggagaccacgaagcacgcggtcagccggggcaccgccaagctgcgctggttcgtggagcggaacctggtgaagcccgagggcaaggtcatcgacctggggtgcggccgcgggggctggtcctactactgcgccgggctcaagaaggtgaccgaggtgaagggctacaccaagggcgggcccggccacgaggagccgatccccatggccacctacgggtggaacctggtcaagctgcacagcggcaaggacgtgttcttcatgccgcccgagaagtgcgacacgctcctgtgcgacatcggggagtccagcccgaaccccaccatcgaggagggccggaccctgcgcgtgctcaagatggtcgagccctggctgaagggcaaccagttctgcatcaagatcctgaacccctacatgccgtccgtggtggagaccctcgagcagatgcagcggaagcacgggggcatgctggtccgcaaccccctgagccggaactccacgcacgagatgtactgggtgagctgcgggaccggcaacatcgtgtccgccgtcaacatgaccagccgcatgctcctgaaccggttcaccatggcgcaccgcaagcccacgtacgagcgcgacgtggacctgggcgccgggacccggcacgtggccgtcgagcccgaggtggccaacctcgacatcatcggccagcgcatcgagaacatcaagaacgagcacaagtccacctggcactacgacgaggacaacccgtacaagacctgggcctaccacgggagctacgaggtgaagccctccggcagcgcgtccagcatggtcaacggggtggtccggctgctgacgaagccctgggacgtgatccccatggtgacccagatcgccatgaccgacaccacgccgttcggccagcagcgcgtcttcaaggagaaggtggacacccggacgccccgcgccaagcggggcaccacgcagatcatggaggtgaccgccaagtggctctgggggttcctgtcccgcaacaagaagccccggatctgcacccgcgaggagttcacccggaaggtccgcagcaacgccgcgatcggcgccgtgttcgtggacgagaaccagtggaacagcgccaaggaggccgtcgaggacgagcggttctgggacctggtgcaccgcgagcgggagctccacaagcaggggaagtgcgcgacgtgcgtgtacaacatgatgggcaagcgcgagaagaagctgggggagttcggcaaggccaagggctcccgggccatctggtacatgtggctgggggcccgcttcctcgagttcgaggccctgggcttcatgaacgaggaccactggttcagccgggagaactccctgagcggggtcgagggcgaggggctccacaagctgggctacatcctgcgcgacatctccaagatcccgggcgggaacatgtacgcggacgacaccgccggctgggacacccggatcaccgaggacgacctccagaacgaggccaagatcacggacatcatggagcccgagcacgccctgctggccaccagcatcttcaagctcacctaccagaacaaggtggtgcgcgtccagcgccccgcgaagaacgggaccgtgatggacgtgatctcccggcgcgaccagcggggcagcggccaggtcgggacgtacggcctgaacaccttcaccaacatggaggtgcagctgatccgccagatggagtccgaggggatcttcctccccagcgagctggagaccccgaacctggccgagcgggtgctcgactggctggagaagcacggcgccgagcgcctgaagcggatggccatctccggggacgactgcgtcgtgaagcccatcgacgaccgcttcgccacggcgctcaccgccctgaacgacatgggcaaggtgcggaaggacatcccccagtgggagcccagcaagggctggaacgactggcagcaggtcccgttctgctcccaccacttccaccagctgatcatgaaggacgggcgcgagatcgtggtgccctgccggaaccaggacgagctcgtcggccgcgcccgggtgagccagggggccggctggtccctgcgcgagaccgcctgcctgggcaagagctacgcgcagatgtggcagctcatgtacttccaccggcgcgacctgcggctggccgccaacgccatctgctccgcggtgcccgtcgactgggtgcccaccagccgcaccacgtggagcatccacgcccaccaccagtggatgaccaccgaggacatgctctccgtgtggaaccgggtctggatcgaggagaacccgtggatggaggacaagacccacgtgagctcctgggaggaggtgccctacctgggcaagcgcgaggaccagtggtgcggcagcctgatcgggctcacggcccgcgccacctgggccaccaacatccaggtcgcgatcaaccaggtgcggcgcctgatcggcaacgagaactacctggactacatgacctccatgaagcggttcaagaacgagagcgaccccgagggggccctctggtga

SEQ ID NO: 7975 - RNA, 9879 nt, synthetic construct
  misc_feature 1..9879: note = derived and/or modified CDS sequence (opt1) from DENV-1__GQ868563__SS-prME
  source 1..9879: mol_type = other RNA
agcgtgaccatgctgctcatgctgctgcccaccgccctcgccttccacctgaccacccgcggcggggagccccacatgatcgtcagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacgccacgttcatcatcgacgggcccgacaccccggagtgccccgacggccagcgcgcgtggaacatctgggaggtcgaggactacgggttcggcatcttcaccaccaacatctggctgaagctccgggactcctacacgcagatgtgcgaccaccgcctgatgagcgccgccatcaaggactccaaggccgtgcacgccgacatgggctactggatcgagagcgagaagaacgagacctggaagctggcgcgggcctccttcatcgaggtgaagacctgcacctggcccaagagccacacgctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcaccacggtggtggtcgacgagcactgcgggaaccggggcccgagcctccgcaccaccaccgtgacggggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggaccctggccgtgttcctgctcctgatcatgggccagctgacgtggaacgacctcacccgcctgtgcatcatggtcggggcgaacgcctccgaccggatgggcatgggcaccacctacctggccctcatggccacgttcaagatgcgcccgatgttcgccgtggggctgctgttccggcgcctcaccagccgggaggtgctgctgctcaccatcgggctgtccctggtcgcgagcgtggagctccccaactccctggaggagctgggggacggcctcgccatgggcatcatgatgctgaagctgctcaccgagttccagccccaccagctgtggacgaccctgctcagcctgaccttcgtcaagaccacgctgtccctcgactacgcctggaagaccaccgccatggtgctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggcgatcgggatcgtgagcatcctgctctccagcctgctgaagaacgacgtgcccctcgccggcccgctgatcgccggcgggatgctgatcgcctgctacgtcatcagcggctccagcgccgacctctccctggagaaggcggccgaggtgagctgggagcaggaggccgagcactccggggccagccacaacatcctggtggaggtccaggacgacggcacgatgaagatcaaggacgaggagcgggacgacaccctcaccatcctgctgaaggccaccctcctggcggtgtccggggtgtaccccatgagcatccccgccacgctgttcgtctggtacttctggcagaagaagaagcagcgctccggcgtgctctgggacacccccagcccgcccgaggtggagcgggccgtcctggacgacggcatctaccgcatcctgcagcgggggctgctcggccgctcccaggtgggggtgggcgtcttccaggacggggtgttccacaccatgtggcacgtgacccggggcgccgtcctgatgtaccagggcaagcgcctggagcccagctgggcctccgtgaagaaggacctcatcagctacgggggcgggtggcggttccagggcctgtggaacacgggggaggaggtgcaggtcatcgcggtggagcccggcaagaacccgaagaacgtgcagaccacccccggcaccttcaagacgcccgagggggaggtcggcgccatcgccctggacttcaagcccgggacctccggcagcccgatcgtgaaccgcgagggcaagatcgtggggctctacggcaacggggtcgtgaccacctccggcacgtacgtgagcgccatcgcccaggcgaaggcctcccaggaggggcccctgcccgagatcgaggacgaggtcttcaagaagcggaacctgaccatcatggacctccacccgggcagcggcaagacccgccggtacctgcccgccatcgtgcgcgaggccatcaagcggaagctgcgcaccctcatcctggcgcccacgcgcgtggtcgccagcgagatggccgaggccctgaaggggatgcccatccggtaccagaccaccgccgtgaagtccgagcacaccggccgcgagatcgtggacctcatgtgccacgcgacgttcaccatgcggctgctgagcccggtccgcgtgcccaactacaacatgatcatcatggacgaggcccacttcaccgaccccgcctccatcgccgcccgggggtacatcagcacccgcgtgggcatgggggaggcggccgccatcttcatgacggccacgccgcccggctccgtcgaggccttcccccagagcaacgcggtgatccaggacgaggagcgggacatccccgagcgctcctggaacagcggctacgactggatcaccgacttccccgggaagaccgtgtggttcgtcccctccatcaagagcggcaacgacatcgccaactgcctccggaagaacgggaagcgcgtgatccagctgtcccggaagacgttcgacaccgagtaccagaagaccaagaacaacgactgggactacgtggtcaccacggacatcagcgagatgggcgccaacttccgcgccgaccgggtgatcgacccccgccggtgcctgaagcccgtgatcctcaaggacgggcccgagcgcgtcatcctggcgggcccgatgcccgtgaccgtcgcctccgccgcccagcggcgcggccggatcgggcgcaaccagaacaaggagggcgaccagtacgtgtacatggggcagcccctgaacaacgacgaggaccacgcccactggaccgaggcgaagatgctcctggacaacatcaacacccccgagggcatcatcccggccctgttcgagcccgagcgcgagaagtccgccgccatcgacggggagtaccggctccgcggcgaggcccggaagacgttcgtggagctgatgcgccggggcgacctgcccgtctggctctcctacaaggtggcgagcgaggggttccagtactccgaccgccggtggtgcttcgacggcgagcgcaacaaccaggtgctggaggagaacatggacgtcgagatctggaccaaggagggggagcggaagaagctgcgcccccggtggctcgacgcccgcacctacagcgacccgctggccctgcgggagttcaaggagttcgccgccggccgccggtccgtgagcggcgacctcatcctggagatcgggaagctgccccagcacctcaccctgcgcgcgcagaacgccctggacaacctcgtgatgctgcacaacagcgagcagggcgggaaggcctaccggcacgccatggaggagctgcccgacaccatcgagacgctcatgctgctggcgctcatcgccgtcctgaccggcggggtgaccctgttcttcctctccggcaagggcctggggaagaccagcatcggcctgctctgcgtgacggcctccagcgccctgctgtggatggcctccgtcgagccccactggatcgcggccagcatcatcctcgagttcttcctgatggtgctgctcatcccggagcccgaccgccagcggacgccccaggacaaccagctggcctacgtggtcatcgggctcctcttcatgatcctgaccgtggccgccaacgagatgggcctgctcgagaccacgaagaaggacctggggatcggctacgcggccgccgagaaccaccagcacgccaccatgctggacgtggacctccgcccggcctccgcgtggaccctgtacgccgtcgccaccacggtgatcacccccatgatgcggcacaccatcgagaacaccacggccaacatcagcctgaccgccatcgcgaaccaggccgccatcctcatgggcctggacaaggggtggcccatctccaagatggacatcggcgtgcccctgctcgccctggggtgctacagccaggtcaacccgctgaccctcaccgcggccgtgctgatgctggtggcccactacgccatcatcggccccgggctccaggccaaggcgacgcgcgaggcccagaagcgcaccgccgccggcatcatgaagaaccccaccgtcgacggcatcgtggccatcgacctggaccccgtggtctacgacgcgaagttcgagaagcagctggggcagatcatgctcctgatcctgtgcacctcccagatcctcctgatgcggacgacctgggccctgtgcgagagcatcaccctcgccaccggcccgctgacgaccctgtgggaggggtcccccggcaagttctggaacaccaccatcgccgtgagcatggccaacatcttccgcggctcctacctcgcgggggccggcctggccttcagcctgatgaagtccctcgggggcgggcggcgcggcacgggcgcccagggggagaccctgggcgagaagtggaagcggcagctgaaccagctcagcaagtccgagttcaacacctacaagcgcagcgggatcatggaggtggaccggagcgaggcgaaggagggcctgaagcgcggggagaccacgaagcacgccgtctcccggggcaccgccaagctgcgctggttcgtggagcggaacctggtgaagcccgagggcaaggtcatcgacctcgggtgcggccgcgggggctggagctactactgcgccgggctgaagaaggtgaccgaggtgaagggctacaccaagggcgggcccggccacgaggagccgatccccatggccacctacgggtggaacctggtcaagctccactccggcaaggacgtgttcttcatgccgcccgagaagtgcgacacgctgctgtgcgacatcggggagagctccccgaaccccaccatcgaggagggccggaccctccgcgtgctgaagatggtcgagccctggctgcggggcaaccagttctgcatcaagatcctcaacccctacatgccgagcgtggtggagaccctggagcagatgcagcgcaagcacgggggcatgctggtccggaaccccctctcccgcaacagcacgcacgagatgtactgggtgtcctgcgggaccggcaacatcgtgagcgcggtcaacatgacctcccggatgctgctgaaccgcttcaccatggcccaccgcaagcccacgtacgagcgggacgtggacctcggcgccgggacccgccacgtggccgtcgagcccgaggtgccgaacctggacatcatcggccagcggatcgagaacatcaagaacgagcacaagagcacctggcactacgacgaggacaacccctacaagacctgggcctaccacgggtcctacgaggtgaagcccagcggctccgcgagctccatggtcaacggggtggtccgcctgctcacgaagccctgggacgtgatcccgatggtgacccagatcgccatgaccgacaccacgcccttcggccagcagcgggtcttcaaggagaaggtggacacccgcacgccccgggccaagcgcggcaccacgcagatcatggaggtgaccgccaagtggctgtgggggttcctgagccggaacaagaagccgcgcatctgcacccgggaggagttcacccgcaaggtccggtccaacgccgcgatcggcgccgtgttcgtggacgagaaccagtggaacagcgccaaggaggccgtcgaggacgagcgcttctgggacctcgtgcaccgggagcgcgagctgcacaagcaggggaagtgcgcgacgtgcgtgtacaacatgatgggcaagcgggagaagaagctgggggagttcggcaaggccaagggcagccgcgccatctggtacatgtggctcggggcccggttcctggagttcgaggccctgggcttcatgaacgaggaccactggttctcccgcgagaacagcctctccggggtcgagggcgaggggctgcacaagctgggctacatcctccgggacatcagcaagatccccggcgggaacatgtacgcggacgacaccgccggctgggacacccgcatcaccgaggacgacctgcagaacgaggccaagatcacggacatcatggagcccgagcacgccctgctcgccacctccatcttcaagctgacctaccagaacaaggtggtgcgcgtccagcggcccgcgaagaacgggaccgtgatggacgtgatcagccgccgggaccagcgcggctccggccaggtcgggacgtacggcctgaacaccttcaccaacatggaggtgcagctcatccggcagatggagagcgaggggatcttcctgccgtccgagctggagacccccaacctcgccgagcgcgtgctggactggctggagaagcacggcgccgagcggctcaagcgcatggccatcagcggggacgactgcgtcgtgaagcccatcgacgaccggttcgccacggcgctgaccgccctgaacgacatgggcaaggtgcgcaaggacatcccccagtgggagccgtccaagggctggaacgactggcagcaggtccccttctgcagccaccacttccaccagctcatcatgaaggacgggcgggagatcgtggtgccctgccgcaaccaggacgagctggtcggccgggcccgcgtgtcccagggggccggctggagcctgcgggagaccgcctgcctcgggaagtcctacgcgcagatgtggcagctgatgtacttccaccgccgggacctgcgcctcgccgccaacgccatctgcagcgcggtgcccgtcgagtgggtgccgacctcccggaccacgtggagcatccacgcccaccaccagtggatgaccaccgaggacatgctgagcgtgtggaaccgcgtctggatcgaggagaacccctggatggaggacaagacccacgtgtccagctgggaggaggtgccctacctgggcaagcgcgaggaccagtggtgcggctccctcatcgggctgacggcccgggccacctgggccaccaacatccaggtcgcgatcaaccaggtgcgccggctgatcggcaacgagaactacctcgactacatgaccagcatgaagcgcttcaagaacgagtccgaccccgagggggccctgtggtga

SEQ ID NO: 7976 - RNA, 9879 nt, synthetic construct
  misc_feature 1..9879: note = derived and/or modified CDS sequence (opt1) from DENV-1__GQ868564__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaaggcgctgctgttcaagaccagcgccggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgctcccagaccggcgagcaccggcgcgacaagcggagcgtggcgctggcgccccacgtgggcctggggctcgagacccgcaccgagacctggatgtccagcgagggcgcctggaagcagatccagcgggtcgagacctgggccctgcgccaccccgggttcacggtgatcgccctgttcctcgcccacgccatcggcacctccatcacccagaaggggatcatcttcatcctgctgatgctcgtgacccccagcatggccatgcggtgcgtcggcatcggcaaccgcgacttcgtggaggggctgtccggcgccacgtgggtggacgtcgtgctggagcacgggagctgcgtgaccaccatggcgaagaacaagcccaccctcgacatcgagctgctgaagacggaggtcaccaaccccgccgtgctccggaagctgtgcatcgaggccaagatctccaacaccaccacggacagccgctgcccgacccagggcgaggccaccctggtggaggagcaggacgccaacttcgtctgccggcgcaccttcgtggaccggggctgggggaacggctgcggcctcttcggcaaggggtccctgctgacgtgcgcgaagttcaagtgcgtgaccaagctcgagggcaagatcgtccagtacgagaacctgaagtacagcgtgatcgtgaccgtccacaccggcgaccagcaccaggtggggaacgagacgaccgagcacggcaccatcgccaccatcacgccccaggcccccacgtccgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggaccagcggggcctccaccagccaggagacctggaaccggcaggacctcctggtgacgttcaagaccgcgcacgccaagaagcaggaggtcgtggtgctgggcagccaggagggcgccatgcacaccgccctcaccggggccacggagatccagacctccggcaccaccacgatcttcgcggggcacctgaagtgccgcctgaagatggacaagctcaccctgaagggcatgagctacgtcatgtgcaccgggtccttcaagctggagaaggaggtggccgagacccagcacggcacggtgctggtccaggtgaagtacgagggcaccgacgccccctgcaagatccccttcagcacccaggacgagaagggggtgacccagaacggccggctcatcacggccaacccgatcgtcaccgacaaggagaagcccgtgaacatcgagaccgagccgcccttcggggagtcctacatcgtggtcggcgcgggcgagaaggccctgaagctgagctggttcaagaaggggtccagcatcggcaagatgttcgaggccaccgcccgcggggcccggcgcatggcgatcctcggcgacacggcctgggacttcgggtccatcggcggcgtgttcaccagcgtggggaagctggtccaccaggtgttcggcaccgcctacggggtgctgttctccggcgtcagctggaccatgaagatcgggatcggcatcctcctgacgtggctgggcctcaactcccgcagcacctccctgagcatgacctgcatcgccgtggggatggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggcggactccccgaagcgcctgagcgccgccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgcgaacggcatcctggcccaggggaagaagatgatccggccccagcccatggagcacaagtacagctggaagtcctggggcaaggccaagatcatcggcgccgacatccagaacacgaccttcatcatcgacgggcccgacaccccggagtgccccgacggccagcgcgcgtggaacatctgggaggtcgaggactacgggttcggcatcttcaccacgaacatctggctgaagctccgggacagctacacccagatgtgcgaccaccgcctgatgtccgccgccatcaaggacagcaaggccgtgcacgccgacatgggctactggatcgagtccgagaagaacgagacctggaagctggcgcgggccagcttcatcgaggtgaagacctgcacgtggcccaagtcccacaccctctggagcaacggggtcctggagtccgagatgatcatccccaagatctacggcgggccgatcagccagcacaactaccgccccggctacttcacccagaccgccgggccctggcacctgggcaagctcgagctggacttcgacctgtgcgagggcacgaccgtggtggtcgacgagcactgcgggaaccggggcccgtccctccgcaccaccacggtgaccgggaagatcatccacgagtggtgctgccggagctgcaccctgccgcccctgcgcttccggggcgaggacgggtgctggtacggcatggagatccgccccgtgaaggagcgggaggagaacctcgtccgctccatggtgagcgccggctccggggaggtggacagcttcagcctgggcatcctgtgcgtctccatcatgatcgaggaggtgatgcggagccgctggtcccgcaagatgctcatgaccgggacgctggccgtgttcctgctcctgatcatgggccagctgacctggaacgacctcacccggctgtgcatcatggtcggggcgaacgccagcgaccgcatgggcatgggcaccacgtacctggccctcatggccaccttcaagatgcggccgatgttcgccgtggggctgctgttccgccggctcacctcccgcgaggtgctgctgctcaccatcggcctgagcctggtcgcgtccgtggagctccccaacagcctggaggagctgggggacggcctcgccatgggcatcatgatgctgaagctgctcacggagttccagccccaccagctgtggaccaccctgctctccctgaccttcgtcaagacgaccctgagcctcgactacgcctggaagaccaccgccatggtgctgtccatcgtgagcctgttccccctctgcctgtccacgaccagccagaagaccacctggctgccggtcctcctggggtccttcggctgcaagcccctgaccatgttcctcatcacggagaacaagatctgggggcgcaagagctggcccctgaacgagggcatcatggcgatcgggatcgtgtccatcctgctcagctccctgctgaagaacgacgtgcccctcgccggcccgctgatcgccggcgggatgctgatcgcctgctacgtcatcagcggcagctccgccgacctcagcctggagaaggcggccgaggtgtcctgggagcacgaggccgagcacagcggggcctcccacaacatcctggtggaggtccaggacgacggcaccatgaagatcaaggacgaggagcgcgacgacaccctcaccatcctgctgaaggccgcgctcctggccgtgagcggggtgtaccccatgtccatccccgccacgctgttcgtctggtacttctggcagaagaagaagcagcggagcggcgtgctctgggacaccccctccccgcccgaggtggagcgcgccgtcctggacgacggcatctaccggatcctgcagcgcgggctgctcggccggagccaggtgggggtgggcgtcttccaggacggggtgttccacaccatgtggcacgtgacccgcggcgccgtcctgatgtaccagggcaagcggctggagccctcctgggcgagcgtgaagaaggacctcatctcctacgggggcgggtggcgcttccagggcagctggaacacgggggaggaggtgcaggtcatcgccgtggagcccggcaagaacccgaagaacgtgcagaccacccccggcaccttcaagacgcccgagggggaggtcggcgccatcgccctggacttcaagcccgggacctccggcagcccgatcgtgaaccgggagggcaagatcgtggggctgtacggcaacggggtcgtgaccacctccggcacgtacgtgagcgccatcgcgcaggccaaggcctcccaggaggggcccctccccgagatcgaggacgaggtcttcaagaagcgcaacctgaccatcatggacctgcacccgggcagcggcaagacccggcgctacctccccgccatcgtgcgggaggcgatcaagcgcaagctgcgcaccctgatcctcgcccccacgcgggtggtcgccagcgagatggccgaggccctgaaggggatgcccatccgctaccagaccaccgcggtgaagtccgagcacaccggccgggagatcgtggacctgatgtgccacgccacgttcaccatgcgcctcctgagcccggtccgggtgcccaactacaacatgatcatcatggacgaggcccacttcaccgaccccgcctccatcgccgcgcgcgggtacatcagcacccgggtgggcatgggggaggccgccgccatcttcatgacggccacgccgcccggctccgtcgaggcgttcccccagagcaacgccgtgatccaggacgaggagcgcgacatccccgagcggtcctggaacagcggctacgactggatcaccgacttccccgggaagaccgtgtggttcgtcccctccatcaagagcggcaacgacatcgccaactgcctgcgcaagaacgggaagcgggtgatccagctctcccgcaagacgttcgacaccgagtaccagaagaccaagaacaacgactgggactacgtggtcaccacggacatcagcgagatgggcgccaacttccgggcggaccgcgtgatcgacccccggcgctgcctgaagcccgtgatcctgaaggacgggcccgagcgggtcatcctcgccggcccgatgcccgtgaccgtcgcctccgccgcccagcgccggggccgcatcgggcgcaaccagaacaaggagggcgaccagtacgtgtacatggggcagcccctgaacaacgacgaggaccacgcgcactggaccgaggccaagatgctgctcgacaacatcaacacccccgagggcatcatcccggccctgttcgagcccgagcgggagaagtccgccgccatcgacggggagtaccgcctgcggggcgaggcgcgcaagacgttcgtggagctcatgcggcgcggcgacctgcccgtctggctgtcctacaaggtggccagcgaggggttccagtactccgaccggcgctggtgcttcgacggcgagcggaacaaccaggtgctcgaggagaacatggacgtcgagatctggaccaaggagggggagcgcaagaagctgcggccccgctggctggacgcccggacctacagcgacccgctcgccctgcgcgagttcaaggagttcgccgcgggccggcgctccgtgagcggcgacctgatcctcgagatcgggaagctgccccagcacctgaccctccgggcccagaacgccctggacaacctggtgatgctccacaacagcgagcagggcgggaaggcctaccgccacgcgatggaggagctgcccgacaccatcgagacgctgatgctcctggccctgatcgccgtcctcaccggcggggtgaccctgttcttcctgtccggcaagggcctcgggaagaccagcatcggcctgctgtgcgtgacggcctccagcgccctcctgtggatggcgtccgtcgagccccactggatcgccgccagcatcatcctggagttcttcctcatggtgctgctgatcccggagcccgaccggcagcgcacgccccaggacaaccagctcgcctacgtggtcatcgggctgctgttcatgatcctcaccgtggccgcgaacgagatgggcctgctggagaccacgaagaaggacctcgggatcggccacgtggccgccgagaaccaccagcacgccaccatgctggacgtcgacctgcggccggcctccgcgtggaccctctacgccgtggccaccacggtgatcacccccatgatgcgccacaccatcgagaacaccacggccaacatcagcctgaccgccatcgcgaaccaggccgccatcctgatgggcctcgacaaggggtggcccatctccaagatggacatcggcgtccccctgctggccctcgggtgctacagccaggtgaacccgctgaccctgaccgcggccgtgctcatgctggtcgcccactacgccatcatcggccccgggctgcaggccaaggcgacgcgcgaggcccagaagcggaccgccgccggcatcatgaagaaccccaccgtggacggcatcgtggccatcgacctcgaccccgtcgtgtacgacgcgaagttcgagaagcagctggggcagatcatgctgctcatcctgtgcacctcccagatcctgctcatgcgcacgacctgggccctgtgcgagagcatcaccctggccaccggcccgctcacgaccctgtgggaggggtcccccggcaagttctggaacaccaccatcgccgtgagcatggccaacatcttccggggctcctacctggcgggggccggcctcgccttcagcctgatgaagtccctcgggggcgggcgccgggggacgggcgcccagggggagaccctcggcgagaagtggaagcgccagctgaaccagctgagcaagtccgagttcaacacctacaagcggagcgggatcatggaggtcgaccgcagcgaggcgaaggagggcctcaagcgcggggagaccacgaagcacgccgtgtcccgcggcaccgccaagctgcggtggttcgtggagcgcaacctggtcaagcccgagggcaaggtgatcgacctggggtgcggccgcgggggctggagctactactgcgccgggctcaagaaggtgaccgaggtcaagggctacaccaagggcgggcccggccacgaggagccgatccccatggccacctacgggtggaacctggtgaagctgcactccggcaaggacgtgttcttcatgccgcccgagaagtgcgacacgctcctgtgcgacatcggggagagctccccgaaccccaccatcgaggagggccgcaccctgcgggtcctcaagatggtggagccctggctgcgcggcaaccagttctgcatcaagatcctgaacccctacatgccgagcgtggtcgagaccctcgagcagatgcagcggaagcacgggggcatgctggtgcgcaaccccctgtcccggaacagcacgcacgagatgtactgggtgtcctgcgggaccggcaacatcgtcagcgcggtgaacatgacctcccgcatgctcctgaaccgcttcaccatggcccaccggaagcccacgtacgagcgcgacgtggacctgggcgccgggacccggcacgtcgccgtggagcccgaggtggccaacctcgacatcatcggccagcgcatcgagaacatcaagaacgagcacaagagcacctggcactacgacgaggacaacccgtacaagacctgggcgtaccacgggtcctacgaggtcaagcccagcggctccgccagctccatggtgaacggggtcgtgcggctgctgacgaagccctgggacgtgatccccatggtcacccagatcgccatgaccgacaccacgccgttcggccagcagcgcgtgttcaaggagaaggtggacacccggacgccccgggccaagcggggcaccacgcagatcatggaggtcaccgccaagtggctctgggggttcctgagccgcaacaagaagccccggatctgcacccgcgaggagttcacccggaaggtgcgctccaacgcggccatcggcgccgtgttcgtcgacgagaaccagtggaacagcgccaaggaggcggtggaggacgagcggttctgggacctggtgcaccgcgagcgggagctccacaagcaggggaagtgcgccacgtgcgtctacaacatgatgggcaagcgcgagaagaagctgggggagttcggcaaggccaagggcagccgggccatctggtacatgtggctgggggcccgcttcctcgagttcgaggcgctgggcttcatgaacgaggaccactggttctcccgggagaacagcctgtccggggtggagggcgaggggctccacaagctgggctacatcctgcgcgacatcagcaagatcccgggcgggaacatgtacgccgacgacaccgccggctgggacacccgcatcaccgaggacgacctccagaacgaggccaagatcacggacatcatggagcccgagcacgccctgctggcgacctccatcttcaagctcacctaccagaacaaggtggtccgggtgcagcgccccgccaagaacgggaccgtgatggacgtcatcagccggcgcgaccagcggggctccggccaggtggggacgtacggcctgaacaccttcaccaacatggaggtgcagctgatccgccagatggagagcgaggggatcttcctcccctccgagctggagaccccgaacctggccgagcgggtcctcgactggctggagaagcacggcgccgagcgcctgaagcggatggccatcagcggggacgactgcgtggtgaagcccatcgacgaccgcttcgcgacggccctcaccgccctgaacgacatgggcaaggtccggaaggacatcccccagtgggagccctccaagggctggaacgactggcagcaggtcccgttctgcagccaccacttccaccagctgatcatgaaggacgggcgcgagatcgtggtcccctgccggaaccaggacgagctcgtgggccgcgcccgggtgtcccagggggccggctggagcctgcgcgagaccgcgtgcctggggaagtcctacgcccagatgtggcagctcatgtacttccaccggcgcgacctgcggctggccgccaacgcgatctgcagcgccgtccccgtggagtgggtgcccacctcccgcaccacgtggagcatccacgcccaccaccagtggatgaccaccgaggacatgctcagcgtctggaaccgcgtgtggatcgaggagaacccgtggatggaggacaagacccacgtgtccagctgggaggaggtcccctacctgggcaagcgggaggaccagtggtgcggctccctgatcgggctcacggcccgcgccacctgggcgaccaacatccaggtggccatcaaccaggtgcggcgcctgatcggcaacgagaactacctggactacatgaccagcatgaagcggttcaagaacgagtccgaccccgagggggccctctggtga

SEQ ID NO: 7977 - RNA, 9879 nt, synthetic construct
  misc_feature 1..9879: note = derived and/or modified CDS sequence (opt1) from DENV-1__GQ868565__SS-prME
  source 1..9879: mol_type = other RNA
agcgtgaccatgctgctcatgctgctgcccaccgccctcgccttccacctgaccacccgcggcggggagccccacatgatcgtcagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccgcaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaagatcgggatcggcatcctcctgacgtggctgggcctcaacagccgctccaccagcctgtccatgacctgcatcgccgtggggatggtgaccctgtacctcggcgtcatggtgcaggccgacagcgggtgcgtgatcaactggaagggccgggagctgaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgccaacggcatcctggcgcaggggaagaagatgatccggccccagcccatggagcacaagtactcctggaagtcctggggcaaggccaagatcatcggcgccgacatccagaacgccacgttcatcatcgacgggcccgacaccccggagtgccccgacggccagcgcgcgtggaacatctgggaggtcgaggactacgggttcggcatcttcaccaccaacatctggctgaagctccgggactcctacacgcagatgtgcgaccaccgcctgatgagcgccgccatcaaggactccaaggccgtgcacgccgacatgggctactggatcgagagcgagaagaacgagacctggaagctggcgcgggcctccttcatcgaggtgaagacctgcacctggcccaagagccacacgctctggtccaacggggtcctggagagcgagatgatcatccccaagatctacggcgggccgatctcccagcacaactaccgccccggctacttcacccagaccgccgggccctggcacctgggcaagctcgagctggacttcgacctgtgcgagggcaccacggtggtggtcgacgagcactgcgggaaccggggcccgagcctccgcaccaccaccgtgacggggaagatcatccacgagtggtgctgccggtcctgcaccctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggaccctggccgtgttcctgctcctgatcatgggccagctgacgtggaacgacctcacccgcctgtgcatcatggtcggggcgaacgcctccgaccggatgggcatgggcaccacctacctggccctcatggccacgttcaagatgcgcccgatgttcgccgtggggctgctgttccggcgcctcaccagccgggaggtgctgctgctcaccatcgggctgtccctggtcgcgagcgtggagctccccaactccctggaggagctgggggacggcctcgccatgggcatcatgatgctgaagctgctcaccgagttccagccccaccagctgtggacgaccctgctcagcctgaccttcgtcaagaccacgctgtccctcgactacgcctggaagaccaccgccatggtgctgagcatcgtgtccctgttccccctctgcctgagcaccacgtcccagaagaccacctggctgccggtcctcctggggagcttcggctgcaagcccctgaccatgttcctcatcaccgagaacaagatctgggggcgcaagtcctggcccctgaacgagggcatcatggcgatcgggatcgtgagcatcctgctctccagcctgctgaagaacgacgtgcccctcgccggcccgctgatcgccggcgggatgctgatcgcctgctacgtcatcagcggctccagcgccgacctctccctggagaaggcggccgaggtgagctgggagcaggaggccgagcactccggggccagccacaacatcctggtggaggtccaggacgacggcacgatgaagatcaaggacgaggagcgggacgacaccctcaccatcctgctgaaggccaccctcctggcggtgtccggggtgtaccccatgagcatccccgccacgctgttcgtctggtacttctggcagaagaagaagcagcgctccggcgtgctctgggacacccccagcccgcccgaggtggagcgggccgtcctggacgacggcatctaccgcatcctgcagcgggggctgctcggccgctcccaggtgggggtgggcgtcttccaggacggggtgttccacaccatgtggcacgtgacccggggcgccgtcctgatgtaccagggcaagcgcctggagcccagctgggcctccgtgaagaaggacctcatcagctacgggggcgggtggcggttccagggcctgtggaacacgggggaggaggtgcaggtcatcgcggtggagcccggcaagaacccgaagaacgtgcagaccacccccggcaccttcaagacgcccgagggggaggtcggcgccatcgccctggacttcaagcccgggacctccggcagcccgatcgtgaaccgcgagggcaagatcgtggggctctacggcaacggggtcgtgaccacctccggcacgtacgtgagcgccatcgcccaggcgaaggcctcccaggaggggcccctgcccgagatcgaggacgaggtcttcaagaagcggaacctgaccatcatggacctccacccgggcagcggcaagacccgccggtacctgcccgccatcgtgcgcgaggccatcaagcggaagctgcgcaccctcatcctggcgcccacgcgcgtggtcgccagcgagatggccgaggccctgaaggggatgcccatccggtaccagaccaccgccgtgaagtccgagcacaccggccgcgagatcgtggacctcatgtgccacgcgacgttcaccatgcggctgctgagcccggtccgcgtgcccaactacaacatgatcatcatggacgaggcccacttcaccgaccccgcctccatcgccgcccgggggtacatcagcacccgcgtgggcatgggggaggcggccgccatcttcatgacggccacgccgcccggctccgtcgaggccttcccccagagcaacgcggtgatccaggacgaggagcgggacatccccgagcgctcctggaacagcggctacgactggatcaccgacttccccgggaagaccgtgtggttcgtcccctccatcaagagcggcaacgacatcgccaactgcctccggaagaacgggaagcgcgtgatccagctgtcccggaagacgttcgacaccgagtaccagaagaccaagaacaacgactgggactacgtggtcaccacggacatcagcgagatgggcgccaacttccgcgccgaccgggtgatcgacccccgccggtgcctgaagcccgtgatcctcaaggacgggcccgagcgcgtcatcctggcgggcccgatgcccgtgaccgtcgcctccgccgcccagcggcgcggccggatcgggcgcaaccagaacaaggagggcgaccagtacgtgtacatggggcagcccctgaacaacgacgaggaccacgcccactggaccgaggcgaagatgctcctggacaacatcaacacccccgagggcatcatcccggccctgttcgagcccgagcgcgagaagtccgccgccatcgacggggagtaccggctccgcggcgaggcccggaagacgttcgtggagctgatgcgccggggcgacctgcccgtctggctctcctacaaggtggcgagcgaggggttccagtactccgaccgccggtggtgcttcgacggcgagcgcaacaaccaggtgctggaggagaacatggacgtcgagatctggaccaaggagggggagcggaagaagctgcgcccccggtggctcgacgcccgcacctacagcgacccgctggccctgcgggagttcaaggagttcgccgccggccgccggtccgtgagcggcgacctcatcctggagatcgggaagctgccccagcacctcaccctgcgcgcgcagaacgccctggacaacctcgtgatgctgcacaacagcgagcagggcgggaaggcctaccggcacgccatggaggagctgcccgacaccatcgagacgctcatgctgctggcgctcatcgccgtcctgaccggcggggtgaccctgttcttcctctccggcaagggcctggggaagaccagcatcggcctgctctgcgtgacggcctccagcgccctgctgtggatggcctccgtcgagccccactggatcgcggccagcatcatcctcgagttcttcctgatggtgctgctcatcccggagcccgaccgccagcggacgccccaggacaaccagctggcctacgtggtcatcgggctcctcttcatgatcctgaccgtggccgccaacgagatgggcctgctcgagaccacgaagaaggacctggggatcggctacgcggccgccgagaaccaccagcacgccaccatgctggacgtggacctccgcccggcctccgcgtggaccctgtacgccgtcgccaccacggtgatcacccccatgatgcggcacaccatcgagaacaccacggccaacatcagcctgaccgccatcgcgaaccaggccgccatcctcatgggcctggacaaggggtggcccatctccaagatggacatcggcgtgcccctgctcgccctggggtgctacagccaggtcaacccgctgaccctcaccgcggccgtgctgatgctggtggcccactacgccatcatcggccccgggctccaggccaaggcgacgcgcgaggcccagaagcgcaccgccgccggcatcatgaagaaccccaccgtcgacggcatcgtggccatcgacctggaccccgtggtctacgacgcgaagttcgagaagcagctggggcagatcatgctcctgatcctgtgcacctcccagatcctcctgatgcggacgacctgggccctgtgcgagagcatcaccctcgccaccggcccgctgacgaccctgtgggaggggtcccccggcaagttctggaacaccaccatcgccgtgagcatggccaacatcttccgcggctcctacctcgcgggggccggcctggccttcagcctgatgaagtccctcgggggcgggcggcgcggcacgggcgcccagggggagaccctgggcgagaagtggaagcggcagctgaaccagctcagcaagtccgagttcaacacctacaagcgcagcgggatcatggaggtggaccggagcgaggcgaaggagggcctgaagcgcggggagaccacgaagcacgccgtctcccggggcaccgccaagctgcgctggttcgtggagcggaacctggtgaagcccgagggcaaggtcatcgacctcgggtgcggccgcgggggctggagctactactgcgccgggctgaagaaggtgaccgaggtgaagggctacaccaagggcgggcccggccacgaggagccgatccccatggccacctacgggtggaacctggtcaagctccactccggcaaggacgtgttcttcatgccgcccgagaagtgcgacacgctgctgtgcgacatcggggagagctccccgaaccccaccatcgaggagggccggaccctccgcgtgctgaagatggtcgagccctggctgcggggcaaccagttctgcatcaagatcctcaacccctacatgccgagcgtggtggagaccctggagcagatgcagcgcaagcacgggggcatgctggtccggaaccccctctcccgcaacagcacgcacgagatgtactgggtgtcctgcgggaccggcaacatcgtgagcgcggtcaacatgacctcccggatgctgctgaaccgcttcaccatggcccaccgcaagcccacgtacgagcgggacgtggacctcggcgccgggacccgccacgtggccgtcgagcccgaggtggccaacctggacatcatcggccagcggatcgagaacatcaagaacgagcacaagagcacctggcactacgacgaggacaacccgtacaagacctgggcgtaccacgggtcctacgaggtgaagcccagcggctccgccagctccatggtcaacggggtggtccgcctgctcacgaagccctgggacgtgatccccatggtgacccagatcgccatgaccgacaccacgccgttcggccagcagcgggtcttcaaggagaaggtggacacccgcacgccccgggccaagcgcggcaccacgcagatcatggaggtgaccgccaagtggctgtgggggttcctgagccggaacaagaagccccgcatctgcacccgggaggagttcacccgcaaggtccggtccaacgcggccatcggcgccgtgttcgtggacgagaaccagtggaacagcgccaaggaggcggtcgaggacgagcgcttctgggacctcgtgcaccgggagcgcgagctgcacaagcaggggaagtgcgccacgtgcgtgtacaacatgatgggcaagcgggagaagaagctgggggagttcggcaaggccaagggcagccgcgccatctggtacatgtggctcggggcccggttcctggagttcgaggcgctgggcttcatgaacgaggaccactggttctcccgcgagaacagcctctccggggtcgagggcgaggggctgcacaagctgggctacatcctccgggacatcagcaagatcccgggcgggaacatgtacgccgacgacaccgccggctgggacacccgcatcaccgaggacgacctgcagaacgaggccaagatcacggacatcatggagcccgagcacgccctgctcgcgacctccatcttcaagctgacctaccagaacaaggtggtgcgcgtccagcggcccgccaagaacgggaccgtgatggacgtgatcagccgccgggaccagcgcggctccggccaggtcgggacgtacggcctgaacaccttcaccaacatggaggtgcagctcatccggcagatggagagcgaggggatcttcctgccctccgagctggagaccccgaacctcgccgagcgcgtgctggactggctggagaagcacggcgccgagcggctcaagcgcatggccatcagcggggacgactgcgtcgtgaagcccatcgacgaccggttcgcgacggccctgaccgccctgaacgacatgggcaaggtgcgcaaggacatcccccagtgggagccctccaagggctggaacgactggcagcaggtcccgttctgcagccaccacttccaccagctcatcatgaaggacgggcgggagatcgtggtgccctgccgcaaccaggacgagctggtcggccgggcccgcgtgtcccagggggccggctggagcctgcgggagaccgcgtgcctcgggaagtcctacgcccagatgtggcagctgatgtacttccaccgccgggacctgcgcctcgccgccaacgcgatctgcagcgccgtgcccgtcgagtgggtgcccacctcccggaccacgtggagcatccacgcccaccaccagtggatgaccaccgaggacatgctgagcgtgtggaaccgcgtctggatcgaggagaacccgtggatggaggacaagacccacgtgtccagctgggaggaggtgccctacctgggcaagcgcgaggaccagtggtgcggctccctcatcgggctgacggcccgggccacctgggcgaccaacatccaggtcgccatcaaccaggtgcgccggctgatcggcaacgagaactacctcgactacatgaccagcatgaagcgcttcaagaacgagtccgaccccgagggggccctgtggtga

SEQ ID NO: 7978 - RNA, 9879 nt, synthetic construct
  misc_feature 1..9879: note = derived and/or modified CDS sequence (opt1) from DENV-1__GQ868568__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgtgatcggcaccagcatcacccagaaggggatcatcttcatcctgctgatgctcgtcaccccctccatggccatgcggtgcgtgggcatcggcaaccgcgacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccggaagctgtgcatcgaggcgaagatcagcaacaccaccacggactcccgctgcccgacccagggcgaggccaccctggtcgaggagcaggacgccaacttcgtgtgccggcgcaccttcgtggaccggggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccgcaccggcctggacttcaacgagatggtgctcctgacgatgaaggagaagtcctggctggtgcacaagcagtggttcctcgacctgccgctgccctggacctccggggccagcaccagccaggagacctggaaccggcaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccgcctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttctccacccaggacgagaagggggtcacccagaacggccggctcatcacggccaacccgatcgtgaccgacaaggagaagcccgtgaacatcgagaccgagccgcccttcggggagagctacatcgtcgtgggcgccggcgagaaggccctgaagctgtcctggttcaagaaggggagctccatcggcaagatgttcgaggcgaccgcccgcggggcccggcgcatggccatcctcggcgacacggcctgggacttcgggagcatcggcggcgtgttcacctccgtcgggaagctggtgcaccaggtgttcggcaccgcgtacggggtcctgttcagcggcgtgtcctggatcatgaagatcgggatcggcatcctcctgacctggctgggcctcaacagccgctccacgagcctgtccatgacctgcatcgccgtggggatggtcaccctgtacctcggcgtgatggtgcaggccgacagcgggtgcgtcatcaactggaagggccgggagctgaagtgcgggtccggcatcttcgtgaccaacgaggtgcacacgtggaccgagcagtacaagttccaggccgacagcccgaagcgcctgagcgccgcgatcggcaaggcctgggaggagggggtctgcggcatccggtccgccacccgcctcgagaacatcatgtggaagcagatcagcaacgagctgaaccacatcctgctcgagaacgacatgaagttcaccgtggtggtcggggacgccaacggcatcctggcccaggggaagaagatgatccggccccagcccatggagcacaagtactcctggaagtcctggggcaaggcgaagatcatcggcgccgacacccagaacacgaccttcatcatcgacgggcccgacaccccggagtgccccgacggccagcgcgcctggaacatctgggaggtggaggactacgggttcggcatcttcaccacgaacatctggctgaagctccgggactcctacacccagatgtgcgaccaccgcctgatgagcgccgcgatcaaggactccaaggccgtgcacgccgacatgggctactggatcgagagcgagaagaacgagacctggaagctggcccgggcctccttcatcgaggtcaagacctgcacgtggcccaagagccacaccctctggtccaacggggtgctggagagcgagatgatcatccccaagatctacggcgggccgatctcccagcacaactaccgccccggctacttcacccagaccgcggggccctggcacctgggcaagctcgagctggacttcgacctgtgcgagggcacgaccgtggtcgtggacgagcactgcgggaaccggggcccgagcctccgcaccaccacggtgaccgggaagatcatccacgagtggtgctgccggtcctgcaccctgccgcccctgcgcttccggggcgaggacgggtgctggtacggcatggagatccgccccgtcaaggagaaggaggagaacctcgtgcggagcatggtgtccgccggcagcggggaggtcgacagcttctccctgggcatcctgtgcgtgagcatcatgatcgaggaggtgatgcgctcccggtggagccgcaagatgctcatgaccgggacgctggccgtcttcctgctcctgatcatgggccagctgacctggaacgacctcacccgcctgtgcatcatggtgggggccaacgcctccgaccggatgggcatgggcaccacgtacctggcgctcatggccaccttcaagatgcgcccgatgttcgccgtggggctgctgttccggcgcctcaccagccgggaggtcctgctgctcaccatcgggctgtccctggtggccagcgtcgagctccccaactccctggaggagctgggggacggcctcgccatgggcatcatgatgctgaagctgctcacggagttccagccccaccagctgtggaccaccctgctcagcctgaccttcgtgaagacgaccctgtccctcgactacgcgtggaagaccaccgccatggtgctgagcatcgtctccctgttccccctctgcctgagcacgacctcccagaagaccacctggctgccggtgctcctggggagcttcggctgcaagcccctgaccatgttcctcatcacggagaacaagatctgggggcgcaagtcctggcccctgaacgagggcatcatggccatcgggatcgtgagcatcctgctctccagcctgctgaagaacgacgtccccctcgccggcccgctgatcgcgggcgggatgctgatcgcctgctacgtgatcagcggctccagcgccgacctctccctggagaaggccgccgaggtgagctgggagcaggaggcggagcactccggggccagccacaacatcctggtcgaggtgcaggacgacggcaccatgaagatcaaggacgaggagcgggacgacaccctcaccatcctgctgaaggccacgctcctggccgtgtccggggtctaccccatgagcatccccgccaccctgttcgtgtggtacttctggcagaagaagaagcagcgctccggcgtgctctgggacacccccagcccgcccgaggtcgagcgggcggtgctggacgacggcatctaccgcatcctgcagcgggggctgctcggccgctcccaggtgggggtcggcgtgttccaggacggggtgttccacaccatgtggcacgtcacgcggggcgccgtgctgatgtaccagggcaagcgcctggagcccagctgggcctccgtgaagaaggacctcatcagctacgggggcgggtggcggttccagggctcctggaacaccggggaggaggtccaggtgatcgccgtggagcccggcaagaacccgaagaacgtccagaccacccccggcacgttcaagacccccgagggggaggtgggcgccatcgcgctggacttcaagcccgggaccagcggctccccgatcgtgaaccgcgagggcaagatcgtcgggctgtacggcaacggggtggtgaccacgagcggcacctacgtctccgccatcgcccaggccaaggccagccaggaggggcccctccccgagatcgaggacgaggtgttcaagaagcggaacctgaccatcatggacctgcacccgggcagcggcaagacccgccggtacctccccgcgatcgtgcgcgaggccatcaagcggaagctgcgcacgctgatcctcgcccccacccgcgtcgtggcctccgagatggcggaggccctgaaggggatgcccatccggtaccagaccaccgccgtcaagagcgagcacacgggccgcgagatcgtcgacctgatgtgccacgccaccttcaccatgcggctcctgtccccggtgcgcgtgcccaactacaacatgatcatcatggacgaggcccacttcaccgaccccgcgagcatcgccgcccgggggtacatctccacgcgcgtcggcatgggggaggccgccgcgatcttcatgaccgccacgccgcccggcagcgtggaggccttcccccagtccaacgccgtgatccaggacgaggagcgggacatccccgagcgcagctggaactccggctacgactggatcaccgacttccccgggaagacggtctggttcgtgcccagcatcaagtccggcaacgacatcgccaactgcctgcggaagaacgggaagcgcgtgatccagctcagccggaagaccttcgacaccgagtaccagaagaccaagaacaacgactgggactacgtcgtgacgaccgacatctccgagatgggcgcgaacttccgcgccgaccgggtgatcgacccccgccggtgcctgaagcccgtcatcctgaaggacgggcccgagcgcgtgatcctcgccggcccgatgcccgtcaccgtggccagcgcggcccagcggcgcggccggatcgggcgcaaccagaacaaggagggcgaccagtacgtgtacatggggcagcccctgaacaacgacgaggaccacgcccactggaccgaggccaagatgctgctcgacaacatcaacacgcccgagggcatcatcccggccctgttcgagcccgagcgcgagaagtccgcggccgtcgacggggagtaccggctgcgcggcgaggcccggaagaccttcgtggagctcatgcgccggggcgacctgcccgtgtggctgagctacaaggtcgcctccgaggggttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgacccgctcgcgctgcgggagttcaaggagttcgccgccggccgccggagcgtcagcggcgacctgatcctcgagatcgggaagctgccccagcacctgaccctccgcgcccagaacgccctggacaacctggtgatgctccacaactccgagcagggcgggaaggcgtaccggcacgccatggaggagctgcccgacacgatcgagaccctgatgctcctggccctgatcgccgtgctcaccggcggggtcaccctgttcttcctgagcggcaagggcctcgggaagacgtccatcggcctgctgtgcgtgaccgcgagctccgccctcctgtggatggccagcgtggagccccactggatcgccgcctccatcatcctggagttcttcctcatggtcctgctgatcccggagcccgaccgccagcggacgccccaggacaaccagctcgcgtacgtggtgatcgggctgctgttcatgatcctcaccgtcgccgccaacgagatgggcctgctggagacgaccaagaaggacctcgggatcggctacgtggccgccgagaaccaccagcacgcgaccatgctggacgtggacctgcgcccggccagcgcctggaccctctacgccgtcgccacgaccgtgatcacccccatgatgcggcacaccatcgagaacacgaccgcgaacatctccctgaccgccatcgccaaccaggccgccatcctgatgggcctcgacaaggggtggcccatcagcaagatggacatcggcgtgcccctgctggcgctcgggtgctactcccaggtcaacccgctgaccctgacggccgccgtgctcatgctggtggcccactacgcgatcatcggccccgggctgcaggccaaggccacccgcgaggcccagaagcgcaccgccgcgggcatcatgaagaaccccaccgtcgacggcatcgtggccatcgacctcgaccccgtggtctacgacgccaagttcgagaagcagctggggcagatcatgctgctcatcctgtgcacgagccagatcctgctcatgcggaccacctgggccctgtgcgagtccatcaccctggccacgggcccgctcaccaccctgtgggaggggagccccggcaagttctggaacaccacgatcgcggtgtccatggccaacatcttccgcggcagctacctggccggggccggcctcgccttctccctgatgaagtccctcgggggcgggcggcgcgggaccggcgcgcagggggagaccctcggcgagaagtggaagcggcagctgaaccagctgtccaagagcgagttcaacacctacaagcgcagcgggatcatggaggtggaccggtccgaggccaaggagggcctcaagcgcggggagacgaccaagcacgccgtcagccggggcaccgccaagctgcgctggttcgtggagcggaacctggtgaagcccgagggcaaggtcatcgacctggggtgcggccgcgggggctggtcctactactgcgcggggctcaagaaggtgaccgaggtgaagggctacaccaagggcgggcccggccacgaggagccgatccccatggccacgtacgggtggaacctggtcaagctgcacagcggcaaggacgtgttcttcatgccgcccgagaagtgcgacaccctcctgtgcgacatcggggagtccagcccgaaccccaccatcgaggagggccggaccctgcgcgtgctcaagatggtcgagccctggctgcggggcaaccagttctgcatcaagatcctgaacccctacatgccgtccgtggtggagacgctcgagcagatgcagcgcaagcacgggggcatgctggtccggaaccccctgagccgcaactccacccacgagatgtactgggtgagctgcgggaccggcaacatcgtgtccgccgtcaacatgaccagccggatgctcctgaaccgcttcacgatggcccaccgcaagcccacctacgagcgggacgtggacctgggcgccgggacccgccacgtggcggtcgagcccgaggtggccaacctcgacatcatcggccagcggatcgagaacatcaagaacgagcacaagtccacctggcactacgacgaggacaacccgtacaagacgtgggcctaccacgggagctacgaggtcaagccctccggcagcgcctccagcatggtgaacggggtggtccgcctgctgaccaagccctgggacgtgatccccatggtgacccagatcgccatgaccgacacgaccccgttcggccagcagcgggtcttcaaggagaaggtggacacccgcacgccccgggcgaagcgcggcacgacccagatcatggaggtgaccgccaagtggctctgggggttcctgtcccggaacaagaagccccgcatctgcacccgggaggagttcacgcgcaaggtccggagcaacgccgccatcggcgccgtgttcgtggacgagaaccagtggaacagcgcgaaggaggccgtcgaggacgagcgcttctgggacctggtgcaccgggagcgcgagctccacaagcaggggaagtgcgcgacctgcgtgtacaacatgatgggcaagcgggagaagaagctgggggagttcggcaaggccaagggctcccgcgcgatctggtacatgtggctgggggcccggttcctcgagttcgaggccctgggcttcatgaacgaggaccactggttcagccgcgagaactccctgagcggggtcgagggcgaggggctccacaagctgggctacatcctgcgggacatctccaagatcccgggcgggaacatgtacgccgacgacaccgccggctgggacacccgcatcacggaggacgacctccagaacgaggcgaagatcaccgacatcatggagcccgagcacgccctgctggccaccagcatcttcaagctcacctaccagaacaaggtggtgcgcgtccagcggcccgccaagaacgggacggtgatggacgtgatctcccgccgggaccagcgcggcagcggccaggtcgggacctacggcctgaacaccttcaccaacatggaggtgcagctgatccggcagatggagtccgaggggatcttcctccccagcgagctggagacgccgaacctggccgagcgcgtgctcgactggctggagaagcacggcgcggagcggctgaagcgcatggccatctccggggacgactgcgtcgtgaagcccatcgacgaccggttcgccaccgccctcaccgccctgaacgacatgggcaaggtgcgcaaggacatcccccagtgggagcccagcaagggctggaacgactggcagcaggtcccgttctgctcccaccacttccaccagctgatcatgaaggacgggcgggagatcgtggtgccctgccgcaaccaggacgagctcgtcggccgggcgcgcgtgagccagggggccggctggtccctgcgggagaccgcctgcctgggcaagagctacgcccagatgtggcagctcatgtacttccaccgccgggacctgcgcctggccgcgaacgccatctgctccgccgtgcccgtcgagtgggtgcccaccagccggacgacctggagcatccacgcccaccaccagtggatgaccaccgaggacatgctctccgtgtggaaccgcgtctggatcgaggagaacccgtggatggaggacaagacgcacgtgagctcctgggaggaggtgccctacctgggcaagcgcgaggaccagtggtgcggcagcctgatcgggctcaccgcgcgggccacctgggccaccaacatccaggtcgccatcaaccaggtgcgccggctgatcggcaacgagaactacctggactacatgacgtccatgaagcgcttcaagaacgagagcgaccccgagggggccctctggtga

SEQ ID NO: 7979 - RNA, 9879 nt, synthetic construct
  misc_feature 1..9879: note = derived and/or modified CDS sequence (opt1) from DENV-1__GQ868569__SS-prME
  source 1..9879: mol_type = other RNA
agcgtgaccatgctgctcatgctgctgcccaccgccctcgccttccacctgaccacccgcggcggggagccccacatgatcgtcagcaagcaggagcggggcaagagcctcctgttcaagaccagcgccggggtgaacatgtgcaccctgatcgccatggacctgggcgagctctgcgaggacaccatgacctacaagtgcccccggatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcgcgaaccccgccgtgctccggaagctgtgcatcgaggccaagatcagcaacaccaccaccgactcccgctgcccgacgcagggcgaggccaccctggtggaggagcaggacgccaacttcgtctgccggcgcaccttcgtggaccggggctgggggaacggctgcggcctgttcggcaaggggagcctgctgacctgcgcgaagttcaagtgcgtgacgaagctcgagggcaagatcgtccagtacgagaacctgaagtactccgtgatcgtgaccgtccacaccggcgaccagcaccaggtggggaacgagaccacggagcacggcaccatcgccaccatcacgccccaggcccccaccagcgagatccagctgacggactacggggccctcaccctggactgcagcccccggaccggcctggacttcaacgagatggtcctcctgaccatgaaggagaagtcctggctggtgcacaagcagtggttcctcgacctgccgctgccctggacgtccggggccagcaccagccaggagacctggaaccggcaggacctcctggtgaccttcaagacggcgcacgccaagaagcaggaggtcgtggtgctgggctcccaggagggcgccatgcacaccgccctcaccggggccaccgagatccagacgagcggcaccaccaccatcttcgcggggcacctgaagtgccgcctgaagatggacaagctcacgctgaagggcatgtcctacgtcatgtgcaccgggagcttcaagctggagaaggaggtggccgagacccagcacggcaccgtgctggtccaggtgaagtacgagggcacggacgccccctgcaagatccccttctccacccaggacgagaagggggtgacccagaacggccggctcatcaccgccaacccgatcgtcacggacaaggagaagcccgtgaacatcgagaccgagccgcccttcggggagagctacatcgtggtcggcgcgggcgagaaggccctgaagctgtcctggttcaagaaggggagctccatcggcaagatgttcgaggccaccgcccgcggggcccggcgcatggcgatcctcggcgacaccgcctgggacttcgggagcatcggcggcgtgttcacgtccgtggggaagctggtccaccaggtgttcggcaccgcctacggggtgctgttcagcggcgtctcctggaccatgaagatcgggatcggcatcctcctgacctggctgggcctcaacagccgctccacgagcctgtccatgacctgcatcgccgtggggatggtgaccctgtacctcggcgtcatggtgcaggccgacagcgggtgcgtgatcaactggaagggccgggagctgaagtgcgggtccggcatcttcgtcaccaacgaggtgcacacgtggaccgagcagtacaagttccaggcggacagcccgaagcgcctgagcgccgccatcggcaaggcctgggaggagggggtgtgcggcatccggtccgccacccgcctcgagaacatcatgtggaagcagatcagcaacgagctgaaccacatcctgctcgagaacgacatgaagttcaccgtcgtggtgggggacgcgaacggcatcctggcccaggggaagaagatgatccggccccagcccatggagcacaagtactcctggaagtcctggggcaaggccaagatcatcggcgccgacatccagaacgcgaccttcatcatcgacgggcccgacacgccggagtgccccgacggccagcgcgcctggaacatctgggaggtcgaggactacgggttcggcatcttcaccaccaacatctggctgaagctccgggactcctacacccagatgtgcgaccaccgcctgatgagcgccgccatcaaggactccaaggccgtgcacgcggacatgggctactggatcgagagcgagaagaacgagacgtggaagctggcccgggcctccttcatcgaggtgaagacctgcacctggcccaagagccacaccctctggtccaacggggtcctggagagcgagatgatcatccccaagatctacggcgggccgatctcccagcacaactaccgccccggctacttcacgcagaccgccgggccctggcacctgggcaagctcgagctggacttcgacctgtgcgagggcaccaccgtggtggtcgacgagcactgcgggaaccggggcccgagcctccgcacgaccaccgtgaccgggaagatcatccacgagtggtgctgccggtcctgcacgctgccgcccctgcgcttccggggcgaggacgggtgctggtacggcatggagatccgccccgtgaaggagaaggaggagaacctcgtccggagcatggtgtccgccggcagcggggaggtggacagcttctccctgggcatcctgtgcgtcagcatcatgatcgaggaggtgatgcgctcccggtggagccgcaagatgctcatgaccgggaccctggcggtgttcctgctcctgatcatgggccagctgacctggaacgacctcacgcgcctgtgcatcatggtcggggccaacgcctccgaccggatgggcatgggcaccacctacctggccctcatggccaccttcaagatgcgcccgatgttcgcggtggggctgctgttccggcgcctcacgagccgggaggtgctgctgctcaccatcggcctgtccctggtcgccagcgtggagctccccaactccctggaggagctgggggacggcctcgccatgggcatcatgatgctgaagctgctcaccgagttccagccccaccagctgtggaccacgctgctcagcctgaccttcgtcaagaccaccctgtccctcgactacgcctggaagacgaccgcgatggtgctgagcatcgtgtccctgttccccctctgcctgagcaccacctcccagaagacgacctggctgccggtcctcctggggagcttcggctgcaagcccctgaccatgttcctcatcaccgagaacaagatctgggggcgcaagtcctggcccctgaacgagggcatcatggccatcgggatcgtgagcatcctgctctccagcctgctgaagaacgacgtgcccctcgccggcccgctgatcgccggcgggatgctgatcgcctgctacgtcatcagcggctccagcgcggacctctccctggagaaggccgccgaggtgagctgggagcaggaggccgagcactccggggccagccacaacatcctggtggaggtccaggacgacggcaccatgaagatcaaggacgaggagcgggacgacacgctcaccatcctgctgaaggcgaccctcctggccgtgtccggggtgtaccccatgagcatccccgccaccctgttcgtctggtacttctggcagaagaagaagcagcgctccggcgtgctctgggacacgcccagcccgcccgaggtggagcgggccgtcctggacgacggcatctaccgcatcctgcagcgggggctgctcggccgctcccaggtgggggtgggcgtcttccaggacggggtgttccacaccatgtggcacgtgacccggggcgccgtcctgatgtaccagggcaagcgcctggagcccagctgggcgtccgtgaagaaggacctcatcagctacgggggcgggtggcggttccagggcctgtggaacatgggggaggaggtgcaggtcatcgccgtggagcccggcaagaacccgcgcaacgtgcagaccacgcccggcaccttcaagacccccgagggggaggtcggcgccatcgccctggacttcaagcccgggacctccggcagcccgatcgtgaaccgggagggcaagatcgtggggctctacggcaacggggtcgtgacgacctccggcacctacgtgagcgccatcgcgcaggccaaggcctcccaggaggggcccctgcccgagatcgaggacgaggtcttcaagaagcgcaacctgaccatcatggacctccacccgggcagcggcaagacgcggcgctacctgcccgccatcgtgcgggaggcgatcaagcgcaagctgcgcaccctcatcctggcccccacccgggtggtcgccagcgagatggccgaggccctgaaggggatgcccatccgctaccagaccacggcggtgaagtccgagcacaccggccgggagatcgtggacctcatgtgccacgccaccttcaccatgcgcctgctgagcccggtccgggtgcccaactacaacatgatcatcatggacgaggcccacttcacggaccccgcctccatcgccgcgcgcgggtacatcagcacccgggtgggcatgggggaggccgccgccatcttcatgaccgccacgccgcccggctccgtcgaggcgttcccccagagcaacgccgtgatccaggacgaggagcgcgacatccccgagcggtcctggaacagcggctacgactggatcacggacttccccgggaagaccgtgtggttcgtcccctccatcaagagcggcaacgacatcgccaactgcctccgcaagaacgggaagcgggtgatccagctgtcccgcaagaccttcgacaccgagtaccagaagacgaagaacaacgactgggactacgtggtcaccaccgacatcagcgagatgggcgccaacttccgggcggaccgcgtgatcgacccccggcgctgcctgaagcccgtgatcctcaaggacgggcccgagcgggtcatcctggccggcccgatgcccgtgaccgtcgcctccgccgcccagcgccggggccgcatcgggcgcaaccagaacaaggagggcgaccagtacgtgtacatggggcagcccctgaacaacgacgaggaccacgcgcactggacggaggccaagatgctcctggacaacatcaacacccccgagggcatcatcccggccctgttcgagcccgagcgggagaagtccgccgccatcgacggggagtaccgcctccggggcgaggcgcgcaagaccttcgtggagctgatgcggcgcggcgacctgcccgtctggctctcctacaaggtggccagcgaggggttccagtactccgaccggcgctggtgcttcgacggcgagcggaacaaccaggtgctggaggagaacatggacgtcgagatctggaccaaggagggggagcgcaagaagctgcggccccgctggctcgacgcccggacgtacagcgacccgctggccctgcgcgagttcaaggagttcgccgcgggccggcgctccgtgagcggcgacctcatcctggagatcgggaagctgccccagcacctcaccctgcgggcccagaacgccctggacaacctcgtgatgctgcacaacagcgagcagggcgggaaggcctaccgccacgcgatggaggagctgcccgacaccatcgagaccctcatgctgctggccctcatcgccgtcctgaccggcggggtgacgctgttcttcctctccggcaagggcctggggaagaccagcatcggcctgctctgcgtgaccgcctccagcgccctgctgtggatggcgtccgtcgagccccactggatcgccgccagcatcatcctcgagttcttcctgatggtgctgctcatcccggagcccgaccggcagcgcacgccccaggacaaccagctggcctacgtggtcatcgggctcctcttcatgatcctgacggtggccgcgaacgagatgggcctgctcgagaccaccaagaaggacctggggatcggctacgccgccgccgagaaccaccagcacgccaccatgctggacgtggacctccggccggcgtccgcctggacgctgtacgccgtcgccaccaccgtgatcacccccatgatgcgccacacgatcgagaacaccaccgccaacatcagcctgaccgcgatcgccaaccaggccgccatcctcatgggcctggacaaggggtggcccatctccaagatggacatcggcgtgcccctgctcgcgctggggtgctacagccaggtcaacccgctgacgctcaccgccgccgtgctgatgctggtggcccactacgccatcatcggccccgggctccaggcgaaggccacccgcgaggcccagaagcggaccgccgccggcatcatgaagaaccccacggtcgacggcatcgtggcgatcgacctggaccccgtggtctacgacgccaagttcgagaagcagctggggcagatcatgctcctgatcctgtgcacctcccagatcctcctgatgcgcaccacctgggccctgtgcgagagcatcacgctcgccaccggcccgctgaccaccctgtgggaggggtcccccggcaagttctggaacacgaccatcgccgtgagcatggcgaacatcttccggggctcctacctcgccggggccggcctggccttcagcctgatgaagtccctcgggggcgggcgccggggcaccggcgcgcagggggagaccctgggcgagaagtggaagcgccagctgaaccagctcagcaagtccgagttcaacacgtacaagcggagcgggatcatggaggtggaccgcagcgaggccaaggagggcctgaagcgcggggagaccaccaagcacgccgtctcccgcggcaccgccaagctgcggtggttcgtggagcgcaacctggtgaagcccgagggcaaggtcatcgacctcgggtgcggccgcggcgggtggagctactactgcgccgggctgaagaaggtgacggaggtgaaggggtacaccaagggcgggcccggccacgaggagccgatccccatggcgacctacgggtggaacctggtcaagctccactccggcaaggacgtgttcttcatgccgcccgagaagtgcgacaccctgctgtgcgacatcggggagagctccccgaaccccaccatcgaggagggccgcacgctccgggtgctgaagatggtcgagccctggctgcgcggcaaccagttctgcatcaagatcctcaacccctacatgccgagcgtggtggagaccctggagcagatgcagcggaagcacgggggcatgctggtccgcaaccccctctcccggaacagcacccacgagatgtactgggtgtcctgcgggaccggcaacatcgtgagcgccgtcaacatgacgtcccgcatgctgctgaaccgcttcaccatggcccaccggaagcccacctacgagcgcgacgtggacctcggcgccgggacccggcacgtggccgtcgagcccgaggtggcgaacctggacatcatcggccagcgcatcgagaacatcaagaacgagcacaagagcacgtggcactacgacgaggacaacccgtacaagacctgggcctaccacgggtcctacgaggtgaagcccagcggctccgccagctccatggtcaacggggtggtccggctgctcaccaagccctgggacgtgatccccatggtgacccagatcgccatgacggacaccaccccgttcggccagcagcgcgtcttcaaggagaaggtggacacccggacgccccgcgccaagcggggcaccacccagatcatggaggtgaccgcgaagtggctgtgggggttcctgagccgcaacaagaagccccggatctgcacgcgcgaggagttcacccggaaggtccgctccaacgccgccatcggcgccgtgttcgtggacgagaaccagtggaacagcgcgaaggaggccgtcgaggacgagcggttctgggacctcgtgcaccgcgagcgggagctgcacaagcaggggaagtgcgcgacctgcgtgtacaacatgatgggcaagcgcgagaagaagctgggggagttcggcaaggccaagggcagccgggccatctggtacatgtggctcggggcgcgcttcctggagttcgaggccctgggcttcatgaacgaggaccactggttctcccgggagaacagcctctccggggtcgagggcgaggggctgcacaagctgggctacatcctccgcgacatcagcaagatcccgggcgggaacatgtacgccgacgacaccgccggctgggacacgcgcatcaccgaggacgacctgcagaacgaggccaagatcaccgacatcatggagcccgagcacgcgctgctcgccacctccatcttcaagctgacgtaccagaacaaggtggtgcgggtccagcgccccgccaagaacgggaccgtgatggacgtgatcagccggcgcgaccagcggggctccggccaggtcgggacctacggcctgaacaccttcacgaacatggaggtgcagctcatccgccagatggagagcgaggggatcttcctgccctccgagctggagaccccgaacctcgccgagcgggtgctggactggctggagaagcacggcgccgagcgcctcaagcggatggcgatcagcggggacgactgcgtcgtgaagcccatcgacgaccgcttcgccaccgccctgaccgccctgaacgacatgggcaaggtgcggaaggacatcccccagtgggagccctccaagggctggaacgactggcagcaggtcccgttctgcagccaccacttccaccagctcatcatgaaggacgggcgcgagatcgtggtgccctgccggaaccaggacgagctggtcggccgcgcccgggtgtcccagggggcgggctggagcctgcgcgagacggcctgcctcgggaagtcctacgcccagatgtggcagctgatgtacttccaccggcgcgacctgcggctcgccgcgaacgccatctgcagcgccgtgcccgtcgagtgggtgcccacctcccgcaccacctggagcatccacgcccaccaccagtggatgaccacggaggacatgctgagcgtgtggaaccgcgtctggatcgaggagaacccgtggatggaggacaagacccacgtgtccagctgggaggaggtgccctacctgggcaagcgggaggaccagtggtgcggctccctcatcgggctgaccgcccgcgcgacctgggccacgaacatccaggtcgccatcaaccaggtgcggcgcctgatcggcaacgagaactacctcgactacatgaccagcatgaagcggttcaagaacgagtccgaccccgagggggccctgtggtga

SEQ ID NO: 7980 - RNA, 9879 nt, synthetic construct
  misc_feature 1..9879: note = derived and/or modified CDS sequence (opt1) from DENV-1__GQ868570__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctcctgttcaagacctccgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtcacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccctgttcctcgcgcacgccatcggcaccagcatcacccagaaggggatcatcttcatcctgctgatgctcgtgaccccctccatggccatgcggtgcgtcggcatcggcaaccgcgacttcgtggaggggctgagcggcgccacgtgggtggacgtcgtgctggagcacgggtcctgcgtgaccaccatggccaagaacaagcccaccctcgacatcgagctgctgaagacggaggtcaccaaccccgcggtgctccggaagctgtgcatcgaggccaagatcagcaacaccaccacggactcccgctgcccgacccagggcgaggccaccctggtggaggagcaggacgccaacttcgtctgccggcgcaccttcgtggaccggggctgggggaacggctgcggcctgttcggcaaggggagcctgctgacgtgcgccaagttcaagtgcgtgaccaagctcgagggcaagatcgtccagtacgagaacctgaagtactccgtgatcgtgaccgtccacaccggcgaccagcaccaggtggggaacgagacgaccgagcacggcaccatcgcgaccatcacgccccaggcccccacgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccggcaggacctcctggtgacgttcaagaccgcccacgcgaagaagcaggaggtcgtggtgctgggctcccaggagggcgccatgcacaccgccctcaccggggccacggagatccagaccagcggcaccaccacgatcttcgccgggcacctgaagtgccgcctgaagatggacaagctcaccctgaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctcatcacggccaacccgatcgtcaccgacaaggagaagcccgtgaacatcgagaccgagccgcccttcggggagagctacatcgtggtcggcgccggcgagaaggcgctgaagctgtcctggttcaagaaggggagctccatcggcaagatgttcgaggccaccgcccgcggggcccggcgcatggccatcctcggcgacacggcgtgggacttcgggagcatcggcggcgtgttcacctccgtggggaagctggtccaccaggtgttcggcaccgcctacggggtgctgttcagcggcgtctcctggaccatgaaggtggggatcggcatcctcctgacgtggctgggcctcaacagccgctccaccagcctgtccatgacctgcatcgccgtggggatggtcaccctgtacctcggcgtgatggtgcaggccgacctggggtgcgtcatcaactggaagggccgggagctgaagtgcgggagcggcatcttcgtgacgaacgaggtgcacacctggaccgagcagtacaagttccaggccgactccccgaagcgcctcagcgcggccatcggcaaggcctgggaggagggggtctgcggcatccggagcgtgacccgcctggagaacatcatgtggaagcagatctccaacgagctgaaccacatcctcctggagaacgacatgaagttcaccgtggtcgtgggggacgccaacggcatcctggcccaggggaagaagatgatccggccccagcccatggagcacaagtacagctggaagtcctggggcaaggcgaagatcatcggcgccgacacgcagaacaccaccttcatcatcgacgggcccgacaccccggagtgccccgacggccagcgcgcctggaacatctgggaggtggaggactacgggttcggcatcttcacgaccaacatctggctcaagctgcgggacagctacacccagatgtgcgaccaccgcctgatgtccgccgcgatcaaggacagcaaggccgtccacgccgacatgggctactggatcgagtccgagaagaacgagacctggaagctcgcccgggccagcttcatcgaggtgaagacgtgcacctggcccaagtcccacaccctgtggagcaacggggtgctggagtccgagatgatcatccccaagatctacggcgggccgatcagccagcacaactaccgccccggctacttcacccagacggcggggccctggcacctcggcaagctggagctggacttcgacctctgcgagggcaccaccgtcgtggtggacgagcactgcgggaaccggggcccgtccctgcgcaccacgaccgtcaccgggaagatcatccacgagtggtgctgccggagctgcaccctgccgcccctgcgcttccggggcgaggacgggtgctggtacggcatggagatccgccccgtgaaggagaaggaggagaacctggtgcggtccatggtcagcgccggctccggggaggtggacagcttcagcctgggcatcctctgcgtgtccatcatgatcgaggaggtcatgcgcagccggtggtcccgcaagatgctgatgacggggaccctggccgtgttcctcctgctgatcatgggccagctcacctggaacgacctgatccgcctgtgcatcatggtgggggccaacgccagcgaccggatgggcatgggcaccacgtacctcgcgctgatggccaccttcaagatgcgcccgatgttcgccgtcgggctcctcttccggcgcctgacctcccgggaggtgctgctcctgaccatcggcctgagcctcgtcgcctccgtggagctgcccaacagcctggaggagctcggggacggcctggccatgggcatcatgatgctgaagctcctgacggagttccagccccaccagctgtggaccaccctcctgtccctgaccttcgtgaagacgaccctcagcctggactacgcgtggaagaccaccgccatggtcctgtccatcgtgagcctcttccccctgtgcctgtccacgaccagccagaagaccacctggctcccggtgctgctggggtccttcggctgcaagcccctcaccatgttcctgatcacggagaacaagatctgggggcgcaagagctggcccctgaacgagggcatcatggccatcgggatcgtctccatcctcctgagctccctgctcaagaacgacgtgcccctggccggcccgctgatcgcgggcgggatgctcatcgcctgctacgtgatcagcggcagctccgccgacctgagcctggagaaggccgccgaggtctcctgggagcaggaggcggagcacagcggggcctcccacaacatcctcgtggaggtgcaggacgacggcaccatgaagatcaaggacgaggagcgggacgacaccctgaccatcctgctcaaggccacgctgctggccgtcagcggggtgtaccccatgtccatccccgccaccctcttcgtgtggtacttctggcagaagaagaagcagcgcagcggcgtcctgtgggacaccccctccccgcccgaggtggagcgggcggtgctggacgacggcatctaccgcatcctgcagcgggggctcctgggccgcagccaggtcggggtgggcgtgttccaggacggggtcttccacaccatgtggcacgtgacgcggggcgccgtgctgatgtaccagggcaagcgcctcgagccctcctgggccagcgtcaagaaggacctgatctcctacgggggcgggtggcggttccagggcagctggaacaccggggaggaggtccaggtgatcgccgtcgagcccggcaagaacccgaagaacgtgcagaccacccccggcacgttcaagacccccgagggggaggtgggcgccatcgcgctggacttcaagcccgggacctccggcagcccgatcgtcaaccgcgagggcaagatcgtggggctctacggcaacggggtggtcaccacgtccggcacctacgtgagcgccatcgcccaggccaaggcctcccaggaggggcccctgcccgagatcgaggacgaggtgttcaagaagcggaacctgaccatcatggacctccacccgggcagcggcaagacccgccggtacctgcccgcgatcgtccgcgaggccatcaagcggaagctgcgcacgctcatcctggcccccacccgcgtggtggccagcgagatggcggaggccctgaaggggatgcccatccggtaccagaccaccgccgtcaagtccgagcacacgggccgcgagatcgtggacctcatgtgccacgccaccttcaccatgcggctgctgagcccggtgcgcgtccccaactacaacatgatcatcatggacgaggcccacttcaccgaccccgcgtccatcgccgcccgggggtacatcagcacgcgcgtgggcatgggggaggccgccgcgatcttcatgaccgccacgccgcccggctccgtggaggccttcccccagagcaacgccgtcatccaggacgaggagcgggacatccccgagcgctcctggaacagcggctacgactggatcaccgacttccccgggaagacggtgtggttcgtgccctccatcaagagcggcaacgacatcgccaactgcctccggaagaacgggaagcgcgtcatccagctgtcccggaagaccttcgacaccgagtaccagaagaccaagaacaacgactgggactacgtggtgacgaccgacatcagcgagatgggcgcgaacttccgcgccgaccgggtcatcgacccccgccggtgcctgaagcccgtgatcctcaaggacgggcccgagcgcgtcatcctggccggcccgatgcccgtgaccgtggcctccgcggcccagcggcgcggccggatcgggcgcaaccagaacaaggagggcgaccagtacgtctacatggggcagcccctgaacaacgacgaggaccacgcccactggaccgaggccaagatgctcctggacaacatcaacacgcccgagggcatcatcccggccctgttcgagcccgagcgcgagaagtccgcggccatcgacggggagtaccggctccgcggcgaggcccggaagaccttcgtggagctgatgcgccggggcgacctgcccgtgtggctctcctacaaggtcgccagcgaggggttccagtactccgaccgccggtggtgcttcgacggcgagcgcaacaaccaggtgctggaggagaacatggacgtggagatctggaccaaggagggggagcggaagaagctgcgcccccggtggctcgacgcccgcacctacagcgacccgctggcgctgcgggagttcaaggagttcgccgccggccgccggtccgtcagcggcgacctcatcctggagatcgggaagctgccccagcacctcaccctgcgcgcccagaacgccctggacaacctcgtgatgctgcacaacagcgagcagggcgggaaggcgtaccggcacgccatggaggagctgcccgacacgatcgagaccctcatgctgctggccctcatcgccgtgctgaccggcggggtcaccctgttcttcctctccggcaagggcctggggaagacgagcatcggcctgctctgcgtgaccgcgtccagcgccctgctgtggatggcctccgtggagccccactggatcgccgccagcatcatcctcgagttcttcctgatggtcctgctcatcccggagcccgacaagcagcgcacgccccaggacaaccagctggcgtacgtggtgatcgggctcctcttcatgatcctggccgtcgccgccaacgagatgggcctgctcgagaccacgaagaaggacctggggatcggctacgtggccaccgagaaccaccagcacgcgaccatgctggacgtggacctccggccggcctccgcctggaccctgtacgccgtcgccacgaccgtgatcacccccatgatgcgccacaccatcgagaacacgaccgcgaacatcagcctgaccgccatcgccaaccaggccgccatcctcatgggcctggacaaggggtggcccatctccaagatggacatcggcgtgcccctgctcgcgctggggtgctacagccaggtcaacccgctgaccctcacggccgccgtgctgatgctggtggcccactacgcgatcatcggccccgggctccaggccaaggccacccgggaggcccagaagcgcaccgccgcgggcatcatgaagaaccccaccgtcgacggcatcgtggccatcgacctggaccccgtggtctacgacgccaagttcgagaagcagctggggcagatcatgctcctgatcctgtgcacgtcccagatcctcctgatgcgcaccacctgggccctgtgcgagagcatcaccctcgccacgggcccgctgaccaccctgtgggaggggtcccccggcaagttctggaacaccacgatcgcggtgagcatggccaacatcttccggggctcctacctcgccggggccggcctggccttcagcctgatgaagtccctcgggggcgggcgccggggcaccggcgcgcagggggagaccctgggcgagaagtggaagcgccagctgaaccagctcagcaagtccgagttcaacatctacaagcggagcgggatcatggaggtggaccgcagcgaggccaaggagggcctgaagcgcggggagaccacgaagcacgccgtctcccgcggcaccgccaagctgcggtggttcgtggagcgcaacctggtgaagcccgagggcaaggtcatcgacctcgggtgcggccgcggcgggtggagctactactgcgcggggctgaagaaggtgaccgaggtgaaggggtacaccaagggcgggcccggccacgaggagccgatccccatggccacctacgggtggaacctggtcaagctccactccggcaaggacgtgttcttcatgccgcccgagaagtgcgacacgctgctgtgcgacatcggggagagctccccgaaccccaccatcgaggagggccgcaccctccgggtgctgaagatggtcgagccctggctgcgcggcaaccagttctgcatcaagatcctcaacccctacatgccgagcgtggtggagaccctggagcagatgcagcggaagcacgggggcatgctggtccgcaaccccctctcccggaacagcacgcacgagatgtactgggtgtcctgcgggaccggcaacatcgtgagcgccgtcaacatgacctcccgcatgctgctgaaccggttcaccatggcccaccgcaagcccacgtacgagcgcgacgtggacctcggcgccgggacccggcacgtggcggtcgagcccgaggtggccaacctggacatcatcggccagcgcatcgagaacatcaagaacgagcacaagagcacctggcactacgacgaggacaacccgtacaagacctgggcctaccacgggtcctacgaggtcaagcccagcggctccgccagctccatggtgaacggggtggtccggctgctcacgaagccctgggacgtgatccccatggtgacccagatcgccatgaccgacaccacgccgttcggccagcagcgcgtcttcaaggagaaggtggacacccggacgccccgcgcgaagcggggcaccacgcagatcatggaggtgaccgccaagtggctgtgggggttcctgagccgcaacaagaagccccggatctgcacccgcgaggagttcacccggaaggtccgctccaacgccgccatcggcgccgtgttcgtggacgagaaccagtggaacagcgcgaaggaggccgtcgaggacgagcggttctgggacctcgtgcaccgcgagcgggagctgcacaagcaggggaagtgcgccacgtgcgtgtacaacatgatgggcaagcgcgagaagaagctgggggagttcggcaaggccaagggcagccgggcgatctggtacatgtggctcggggcccgcttcctggagttcgaggccctgggcttcatgaacgaggaccactggttctcccgggagaacagcctctccggggtcgagggcgaggggctgcacaagctgggctacatcctccgcgacatcagcaagatcccgggcgggaacatgtacgccgacgacaccgccggctgggacacccggatcaccgaggacgacctgcagaacgaggcgaagatcacggacatcatggagcccgagcacgccctgctcgccacctccatcttcaagctgacctaccagaacaaggtggtgcgcgtccagcgccccgccaagaacgggaccgtgatggacgtgatcagccggcgcgaccagcggggctccggccaggtcgggacgtacggcctgaacaccttcaccaacatggaggtgcagctcatccgccagatggagagcgaggggatcttcctgccctccgagctggagaccccgaacctcgccgagcgggtgctggactggctggagaagcacggcgcggagcgcctcaagcggatggccatcagcggggacgactgcgtcgtgaagcccatcgacgaccgcttcgccgccgccctgacggcgctgaacgacatgggcaaggtgcggaaggacatcccccagtgggagccctccaagggctggaacgactggcagcaggtcccgttctgcagccaccacttccaccagctcatcatgaaggacgggcgcgagatcgtggtgccctgccggaaccaggacgagctggtcggccgcgcccgggtgtcccagggggccggctggagcctgcgcgagaccgcctgcctcgggaagtcctacgcccagatgtggcagctgatgtacttccaccggcgcgacctgcggctcgcggccaacgccatctgcagcgccgtgcccgtcgactgggtgcccacctcccgcaccacctggagcatccacgcgcaccaccagtggatgacgaccgaggacatgctgagcgtgtggaaccgggtctggatcgaggagaacccgtggatggaggacaagacccacgtgtccagctgggaggaggtgccctacctgggcaagcgcgaggaccagtggtgcggctccctcatcgggctgaccgcccgcgccacgtgggccaccaacatccaggtcgccatcaaccaggtgcggcgcctgatcggcaacgagaactacctcgactacatgaccagcatgaagcggttcaagaacgagtccgaccccgagggggcgctgtggtga

SEQ ID NO: 7981 - RNA, 9879 nt, synthetic construct
  misc_feature 1..9879: note = derived and/or modified CDS sequence (opt1) from DENV-1__KJ189302__SS-prME
  source 1..9879: mol_type = other RNA
agcgtgaccatgctgctcatgctgctgcccaccgcgctcgccttccacctgaccacccgcggcggggagccccacatgatcgtgagcaagcaggagcggggcaagagcctcctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacccgcaccgagacctggatgagctccgagggcgcctggaagcagatccagcgggtcgagacctgggccctgcgccaccccgggttcacggtgatcgccttcttcctggcgcacgccatcggcaccagcatcacccagaaggggatcatcttcatcctcctgatgctggtgaccccctccatggccatgcggtgcgtcggcatcggcaaccgcgacttcgtggaggggctcagcggcgccacgtgggtggacgtcgtgctggagcacgggtcctgcgtgaccaccatggccaagaacaagcccaccctggacatcgagctcctgaagacggaggtcaccaaccccgcggtgctgcggaagctctgcatcgaggccaagatcagcaacaccaccacggactcccgctgcccgacccagggcgaggccaccctggtggaggagcaggacgccaacttcgtctgccggcgcaccttcgtggaccggggctgggggaacggctgcgggctgttcggcaaggggagcctcctgacgtgcgccaagttcaagtgcgtgaccaagctggagggcaagatcgtccagtacgagaacctcaagtactccgtgatcgtgaccgtccacaccggcgaccagcaccaggtggggaacgagacgaccgagcacggcaccatcgcgaccatcacgccccaggcccccacgagcgagatccagctgaccgactacggggccctgaccctcgactgcagcccccgcaccggcctggacttcaacgagatggtcctgctcacgatgaaggagaagtcctggctggtgcacaagcagtggttcctggacctcccgctgccctggacctccggggccagcaccagccaggagacctggaaccggcaggacctgctcgtgacgttcaagaccgcccacgcgaagaagcaggaggtcgtggtgctgggctcccaggagggcgccatgcacaccgccctgaccggggccacggagatccagaccagcggcaccaccacgatcttcgccgggcacctcaagtgccgcctgaagatggacaagctgaccctcaagggcatgtcctacgtcatgtgcaccgggagcttcaagctggagaaggaggtggcggagacccagcacggcacggtgctggtccaggtgaagtacgagggcaccgacgccccctgcaagatccccttctccacccaggacgagaagggggtgacccagaacggccggctgatcacggccaacccgatcgtcaccgacaaggagaagcccgtgaacatcgagaccgagccgcccttcggggagagctacatcgtggtcggcgccggcgagaaggcgctcaagctgtcctggttcaagaaggggagctccatcggcaagatgttcgaggccaccgcccgcggggcccggcgcatggccatcctgggcgacacggcgtgggacttcgggagcatcggcggcgtgttcacctccgtggggaagctcgtccaccaggtgttcggcaccgcctacggggtgctgttcagcggcgtctcctggaccatgaagatcgggatcggcatcctgctcacgtggctgggcctgaacagccgctccaccagcctctccatgacctgcatcgccgtggggatggtgaccctgtacctgggcgtcatggtgcaggccgacagcgggtgcgtgatcaactggaagggccgggagctcaagtgcgggtccggcatcttcgtcacgaacgaggtgcacacctggaccgagcagtacaagttccaggccgacagcccgaagcgcctgagcgcggccatcggcaaggcctgggaggagggggtgtgcggcatccggtccgccacccgcctggagaacatcatgtggaagcagatcagcaacgagctcaaccacatcctgctggagaacgacatgaagttcaccgtcgtggtgggggacgccaacggcatcctcgcgcaggggaagaagatgatccggccccagcccatggagcacaagtactcctggaagtcctggggcaaggccaagatcatcggcgccgacatccagaacacgaccttcatcatcgacgggcccgacaccccggagtgccccgacggccagcgcgcctggaacatctgggaggtcgaggactacgggttcggcatcttcaccacgaacatctggctgaagctgcgggactcctacacccagatgtgcgaccaccgcctcatgagcgcggccatcaaggactccaaggccgtgcacgccgacatgggctactggatcgagagcgagaagaacgagacctggaagctggcccgggcgtccttcatcgaggtgaagacctgcacgtggcccaagagccacaccctgtggtccaacggggtcctcgagagcgagatgatcatccccaagatctacggcgggccgatctcccagcacaactaccgccccggctacttcacccagaccgccgggccctggcacctgggcaagctggagctcgacttcgacctgtgcgagggcacgaccgtggtggtcgacgagcactgcgggaaccggggcccgagcctgcgcaccaccacggtgaccgggaagatcatccacgagtggtgctgccggtcctgcaccctgccgcccctgcgcttccggggcgaggacgggtgctggtacggcatggagatccgccccgtgaaggagaaggaggagaacctggtccggagcatggtgtccgccggcagcggggaggtggacagcttctccctcggcatcctgtgcgtcagcatcatgatcgaggaggtgatgcgctcccggtggagccgcaagatgctgatgaccgggacgctcgccgtgttcctgctgctcatcatgggccagctgacctggaacgacctgatccgcctctgcatcatggtcggggccaacgcgtccgaccggatgggcatgggcaccacctacctggccctgatggccacgttcaagatgcgcccgatgttcgccgtggggctcctgttccggcgcctgaccagccgggaggtgctcctgctgaccatcggcctctccctggtcgccagcgtggagctgcccaactccctcgaggagctgggggacggcctggcgatgggcatcatgatgctcaagctgctgaccgagttccagccccaccagctctggacgaccctgctgagcctcaccttcgtcaagaccacgctgtccctggactacgcctggaagaccaccgccatggtgctcagcatcgtgtccctgttccccctgtgcctcagcaccacgtcccagaagaccacctggctgccggtcctgctcgggagcttcggctgcaagcccctgaccatgttcctgatcaccgagaacaagatctgggggcgcaagtcctggcccctcaacgagggcatcatggccatcgggatcgtgagcatcctgctgtccagcctcctgaagaacgacgtgcccctggcgggcccgctcatcgccggcgggatgctgatcgcctgctacgtcatcagcggctccagcgccgacctgtccctcgagaaggccgcggaggtgagctgggagcaggaggccgagcactccggggccagccacaacatcctggtggaggtccaggacgacggcacgatgaagatcaaggacgaggagcgggacgacaccctgaccatcctcctgaaggccaccctgctcgccgtgtccggggtgtaccccatgagcatccccgcgacgctgttcgtctggtacttctggcagaagaagaagcagcgctccggcgtgctgtgggacacccccagcccgcccgaggtggagcgggccgtcctcgacgacggcatctaccgcatcctgcagcgggggctgctgggccgctcccaggtgggggtgggcgtcttccaggacggggtgttccacaccatgtggcacgtgacccggggcgccgtcctcatgtaccagggcaagcgcctggagcccagctgggcctccgtgaagaaggacctgatcagctacgggggcgggtggcggttccagggctcctggaacacgggggaggaggtgcaggtcatcgccgtggagcccggcaagaacccgaagaacgtgcagaccacccccggcaccttcaagacgcccgagggggaggtcggcgcgatcgccctcgacttcaagcccgggaccagcggctccccgatcgtgaaccgcgagggcaagatcgtggggctgtacggcaacggggtcgtgaccaccagcggcacgtacgtgtccgccatcgcccaggccaaggcgagccaggaggggcccctgcccgagatcgaggacgaggtcttcaagaagcggaacctcaccatcatggacctgcacccgggcagcggcaagacccgccggtacctgcccgccatcgtgcgcgaggccatcaagcggaagctccgcaccctgatcctggcccccacgcgcgtggtcgcgtccgagatggccgaggccctcaaggggatgcccatccggtaccagaccaccgccgtcaagagcgagcacaccggccgcgagatcgtggacctgatgtgccacgccacgttcaccatgcggctgctctccccggtccgcgtgcccaactacaacatgatcatcatggacgaggcgcacttcaccgaccccgccagcatcgccgcccgggggtacatctccacccgcgtgggcatgggggaggccgcggccatcttcatgacggccacgccgcccggcagcgtcgaggccttcccccagtccaacgccgtgatccaggacgaggagcgggacatccccgagcgcagctggaactccggctacgactggatcaccgacttccccgggaagaccgtgtggttcgtccccagcatcaagtccggcaacgacatcgcgaactgcctgcggaagaacgggaagcgcgtgatccagctgagccggaagacgttcgacaccgagtaccagaagaccaagaacaacgactgggactacgtggtcaccacggacatctccgagatgggcgccaacttccgcgccgaccgggtgatcgacccccgccggtgcctcaagcccgtgatcctgaaggacgggcccgagcgcgtcatcctggccggcccgatgcccgtgaccgtcgcgagcgccgcccagcggcgcggccggatcgggcgcaaccagaacaaggagggcgaccagtacgtgtacatggggcagcccctcaacaacgacgaggaccacgcccactggaccgaggccaagatgctgctggacaacatcaacacccccgagggcatcatcccggccctcttcgagcccgagcgcgagaagtccgccgccatcgacggggagtaccggctgcgcggcgaggcccggaagacgttcgtggagctgatgcgccggggcgacctccccgtctggctgagctacaaggtggcctccgaggggttccagtacagcgaccgccggtggtgcttcgacggcgagcgcaacaaccaggtgctggaggagaacatggacgtcgagatctggaccaaggagggggagcggaagaagctccgcccccggtggctggacgcgcgcacctactccgacccgctggccctccgggagttcaaggagttcgccgccggccgccggagcgtgagcggcgacctgatcctggagatcgggaagctcccccagcacctgaccctgcgcgcccagaacgcgctcgacaacctggtgatgctgcacaactccgagcagggcgggaaggcctaccggcacgccatggaggagctccccgacaccatcgagacgctgatgctgctcgccctgatcgcggtcctgaccggcggggtgaccctcttcttcctgagcggcaagggcctggggaagacctccatcggcctcctgtgcgtgacggccagctccgccctgctctggatggccagcgtcgagccccactggatcgccgcgtccatcatcctggagttcttcctgatggtgctcctgatcccggagcccgaccgccagcggacgccccaggacaaccagctggcctacgtggtcatcgggctcctgttcatgatcctgaccgtggccgccaacgagatgggcctcctggagaccacgaagaaggacctggggatcggctacgtggccgcggagaaccaccagcacgccaccatgctcgacgtcgacctgcgcccggccagcgcctggaccctgtacgccgtggcgaccacggtgatcacccccatgatgcggcacaccatcgagaacaccacggccaacatctccctcaccgccatcgccaaccaggccgcgatcctgatgggcctggacaaggggtggcccatcagcaagatggacatcggcgtccccctcctggccctggggtgctactcccaggtgaacccgctcaccctgaccgccgccgtgctgatgctcgtcgcgcactacgccatcatcggccccgggctgcaggccaaggccacgcgcgaggcccagaagcgcaccgcggccggcatcatgaagaaccccaccgtggacggcatcgtggccatcgacctggaccccgtcgtgtacgacgccaagttcgagaagcagctcgggcagatcatgctgctgatcctctgcaccagccagatcctgctgatgcggacgacctgggccctctgcgagtccatcaccctggcgaccggcccgctgacgaccctctgggaggggagccccggcaagttctggaacaccaccatcgccgtgtccatggccaacatcttccgcggcagctacctggccggggccggcctggcgttctccctcatgaagtccctcgggggcgggcggcgcggcacgggcgcccagggggagaccctgggcgagaagtggaagcggcagctcaaccagctgtccaagagcgagttcaacacctacaagcgcagcgggatcatggaggtcgaccggtccgaggccaaggagggcctgaagcgcggggagaccacgaagcacgccgtgagccggggcaccgcgaagctccgctggttcgtggagcggaacctggtcaagcccgagggcaaggtgatcgacctggggtgcggccgcgggggctggtcctactactgcgccgggctgaagaaggtgaccgaggtcaagggctacaccaagggcgggcccggccacgaggagccgatccccatggccacctacgggtggaacctcgtgaagctgcacagcggcaaggacgtgttcttcatgccgcccgagaagtgcgacacgctgctctgcgacatcggggagtccagcccgtcccccaccatcgaggagggccggaccctgcgcgtcctgaagatggtggagccctggctccggggcaaccagttctgcatcaagatcctgaacccctacatgccgagcgtggtcgagaccctggagcagatgcagcgcaagcacgggggcatgctcgtgcggaaccccctgtcccgcaacagcacgcacgagatgtactgggtgtcctgcgggaccggcaacatcgtcagcgccgtgaacatgacctcccggatgctgctcaaccgcttcaccatggcccaccgcaagcccacgtacgagcgggacgtggacctgggcgcggggacccgccacgtcgccgtggagcccgaggtggccaacctggacatcatcggccagcggatcgagaacatcaagaacgagcacaagagcacctggcactacgacgaggacaacccgtacaagacctgggcctaccacgggtcctacgaggtcaagcccagcggctccgccagctccatggtgaacggggtcgtgcgcctcctgacgaagccctgggacgtgatccccatggtcacccagatcgcgatgaccgacaccacgccgttcggccagcagcgggtgttcaaggagaaggtggacacccgcacgccccgggccaagcgcggcaccacgcagatcatggaggtcaccgccaagtggctgtgggggttcctcagccggaacaagaagccccgcatctgcacccgggaggagttcacccgcaaggtgcggagcaacgccgccatcggcgcggtgttcgtcgacgagaaccagtggaactccgccaaggaggccgtggaggacgagcgcttctgggacctggtgcaccgggagcgcgagctgcacaagcaggggaagtgcgccacgtgcgtctacaacatgatgggcaagcgggagaagaagctcggggagttcggcaaggcgaagggcagccgcgccatctggtacatgtggctgggggcccggttcctggagttcgaggccctcggcttcatgaacgaggaccactggttctcccgcgagaacagcctgtccggggtggagggcgaggggctgcacaagctcggctacatcctgcgggacatcagcaagatcccgggcgggaacatgtacgccgacgacaccgcgggctgggacacccgcatcaccgaggacgacctgcagaacgaggccaagatcacggacatcatggagcccgagcacgccctcctggccacctccatcttcaagctgacctaccagaacaaggtggtccgcgtgcagcggcccgccaagaacgggaccgtgatggacgtcatcagccgccgggaccagcgcggctccggccaggtggggacgtacggcctcaacaccttcaccaacatggaggtgcagctgatccggcagatggagagcgaggggatcttcctgccctccgagctcgagaccccgaacctggcggagcgcgtcctggactggctcgagaagcacggcgccgagcggctgaagcgcatggccatcagcggggacgactgcgtggtgaagcccatcgacgaccggttcgccacggccctgaccgcgctcaacgacatgggcaaggtccgcaaggacatcccccagtgggagccctccaagggctggaacgactggcagcaggtcccgttctgcagccaccacttccaccagctgatcatgaaggacgggcgggagatcgtggtcccctgccgcaaccaggacgagctggtgggccgggcccgcgtgtcccagggggccggctggagcctccgggagaccgcctgcctggggaagtcctacgcccagatgtggcagctgatgtacttccaccgccgggacctccgcctggcggccaacgccatctgcagcgccgtccccgtggactgggtgcccaccagccggaccacgtggtccatccacgcgcaccaccagtggatgaccaccgaggacatgctgagcgtctggaaccgcgtgtggatcgaggagaacccgtggatggaggacaagacccacgtgtccagctgggaggaggtcccctacctcggcaagcgcgaggaccagtggtgcggctccctgatcgggctgacggcccgggccacctgggccaccaacatccaggtggccatcaaccaggtgcgccggctcatcggcaacgagaactacctggactacatgaccagcatgaagcgcttcaagaacgagtccgaccccgagggggcgctgtggtga

SEQ ID NO: 7982 - RNA, 9879 nt, synthetic construct
  misc_feature 1..9879: note = derived and/or modified CDS sequence (opt1) from DENV-1__KJ189303__SS-prME
  source 1..9879: mol_type = other RNA
agcgtgaccatgctgctcatgctgctgcccaccgccctcgccttccacctgaccacccgcggcggggagccccacatgatcgtgagcaagcaggagcggggcaagagcctgctgttcaagaccagcgccggggtgaacatgtgcaccctgatcgccatggacctgggcgagctctgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctggcgccccacgtgggcctggggctcgagacgcgcaccgagacctggatgagctccgagggcgcctggaagcagatccagcgggtcgagacctgggccctgcgccaccccgggttcacggtgatcgccctgttcctcgcgcacgtgatcggcaccagcatcacccagaaggggatcatcttcatcctgctgatgctcgtcaccccctccatggccatgcggtgcgtgggcatcggcaaccgcgacttcgtggaggggctgagcggcgccacgtgggtcgacgtggtgctggagcacgggtcctgcgtcaccaccatggccaagaacaagcccaccctcgacatcgagctgctgaagacggaggtgaccaaccccgccgtgctccggaagctgtgcatcgaggcgaagatcagcaacaccaccacggactcccgctgcccgacccagggcgaggccaccctggtcgaggagcaggacgccaacttcgtgtgccggcgcaccttcgtggaccggggctgggggaacggctgcggcctcttcggcaaggggagcctgctgacgtgcgccaagttcaagtgcgtcaccaagctcgagggcaagatcgtgcagtacgagaacctgaagtactccgtgatcgtcaccgtgcacaccggcgaccagcaccaggtcgggaacgagacgaccgagcacggcaccatcgccaccatcacgccccaggcgcccacgagcgagatccagctgaccgactacggggccctcaccctggactgcagcccccgcaccggcctggacttcaacgagatggtgctcctgacgatgaaggagaagtcctggctggtgcacaagcagtggttcctcgacctgccgctgccctggacctccggggccagcaccagccaggagacctggaaccggcaggacctcctggtcacgttcaagaccgcccacgccaagaagcaggaggtggtggtcctgggctcccaggagggcgcgatgcacaccgccctcaccggggccacggagatccagaccagcggcaccaccacgatcttcgccgggcacctgaagtgccgcctgaagatggacaagctcaccctgaagggcatgtcctacgtgatgtgcaccgggagcttcaagctggagaaggaggtggccgagacccagcacggcacggtcctggtccaggtgaagtacgagggcaccgacgcgccctgcaagatccccttctccacccaggacgagaagggggtcacccagaacggccggctcatcacggccaacccgatcgtgaccgacaaggagaagcccgtgaacatcgagaccgagccgcccttcggggagagctacatcgtcgtgggcgccggcgagaaggccctgaagctgtcctggttcaagaaggggagctccatcggcaagatgttcgaggcgaccgcccgcggggcccggcgcatggccatcctcggcgacacggcctgggacttcgggagcatcggcggcgtgttcacctccgtcgggaagctggtgcaccaggtgttcggcaccgcgtacggggtcctgttcagcggcgtgtcctggaccatgaagatcgggatcggcatcctcctgacgtggctgggcctcaacagccgctccaccagcctgtccatgacctgcatcgccgtggggatggtcaccctgtacctcggcgtgatggtgcaggccgacagcgggtgcgtcatcaactggaagggccgggagctgaagtgcgggtccggcatcttcgtgacgaacgaggtgcacacctggaccgagcagtacaagttccaggccgacagcccgaagcgcctgagcgccgcgatcggcaaggcctgggaggagggggtctgcggcatccggtccgccacccgcctcgagaacatcatgtggaagcagatcagcaacgagctgaaccacatcctgctcgagaacgacatgaagttcaccgtggtggtcggggacgccaacggcatcctggcccaggggaagaagatgatccggccccagcccatggagcacaagtactcctggaagtcctggggcaaggcgaagatcatcggcgccgacacgcagaacaccaccttcatcatcgacgggcccgacaccccggagtgccccgacggccagcgcgcctggaacatctgggaggtggaggactacgggttcggcatcttcacgaccaacatctggctgaagctccgggactcctacacccagatgtgcgaccaccgcctgatgagcgccgcgatcaaggactccaaggccgtgcacgccgacatgggctactggatcgagagcgagaagaacgagacctggaagctggcccgggcctccttcatcgaggtcaagacgtgcacctggcccaagagccacaccctctggtccaacggggtgctggagagcgagatgatcatccccaagatctacggcgggccgatctcccagcacaactaccgccccggctacttcacccagacggcggggccctggcacctgggcaagctcgagctggacttcgacctgtgcgagggcaccaccgtggtcgtggacgagcactgcgggaaccggggcccgagcctccgcaccacgaccgtgaccgggaagatcatccacgagtggtgctgccggtcctgcaccctgccgcccctgcgcttccggggcgaggacgggtgctggtacggcatggagatccgccccgtcaaggagaaggaggagaacctcgtgcggagcatggtgtccgccggcagcggggaggtcgacagcttctccctgggcatcctgtgcgtgagcatcatgatcgaggaggtgatgcgctcccggtggagccgcaagatgctcatgacggggaccctggccgtcttcctgctcctgatcatgggccagctgacctggaacgacctcacccgcctgtgcatcatggtgggggccaacgcctccgaccggatgggcatgggcacgacctacctggcgctcatggccaccttcaagatgcgcccgatgttcgccgtggggctgctgttccggcgcctcaccagccgggaggtcctgctgctcacgatcgggctgtccctggtggccagcgtcgagctccccaactccctggaggagctgggggacggcctcgccatgggcatcatgatgctgaagctgctcaccgagttccagccccaccagctgtggaccaccctgctcagcctgacgttcgtgaagaccaccctgtccctcgactacgcgtggaagaccacggccatggtgctgagcatcgtctccctgttccccctctgcctgagcaccacctcccagaagaccacctggctgccggtgctcctggggagcttcggctgcaagcccctgacgatgttcctcatcaccgagaacaagatctgggggcgcaagtcctggcccctgaacgagggcatcatggccatcgggatcgtgagcatcctgctctccagcctgctgaagaacgacgtccccctcgccggcccgctgatcgcgggcgggatgctgatcgcctgctacgtgatcagcggctccagcgccgacctctccctggagaaggccgccgaggtgagctgggagcaggaggcggagcactccggggccagccacaacatcctggtcgaggtgcaggacgacggcaccatgaagatcaaggacgaggagcgggacgacaccctcacgatcctgctgaaggccaccctcctggccgtgtccggggtctaccccatgagcatccccgccaccctgttcgtgtggtacttctggcagaagaagaagcagcgctccggcgtgctctgggacacccccagcccgcccgaggtcgagcgggcggtgctggacgacggcatctaccgcatcctgcagcgggggctgctcggccgctcccaggtgggggtcggcgtgttccaggacggggtgttccacacgatgtggcacgtcacccggggcgccgtgctgatgtaccagggcaagcgcctggagcccagctgggcctccgtgaagaaggacctcatcagctacgggggcgggtggcggttccagggctcctggaacaccggggaggaggtccaggtgatcgccgtggagcccggcaagaacccgaagaacgtccagaccacgcccggcaccttcaagacccccgagggggaggtgggcgccatcgcgctggacttcaagcccgggaccagcggctccccgatcgtgaaccgcgagggcaagatcgtcgggctgtacggcaacggggtggtgacgaccagcggcacctacgtctccgccatcgcccaggccaaggccagccaggaggggcccctccccgagatcgaggacgaggtgttcaagaagcggaacctgaccatcatggacctgcacccgggcagcggcaagacgcgccggtacctccccgcgatcgtgcgcgaggccatcaagcggaagctgcgcaccctgatcctcgcccccacccgcgtcgtggcctccgagatggcggaggccctgaaggggatgcccatccggtaccagaccacggccgtcaagagcgagcacaccggccgcgagatcgtcgacctgatgtgccacgccaccttcaccatgcggctcctgtccccggtgcgcgtgcccaactacaacatgatcatcatggacgaggcccacttcacggaccccgcgagcatcgccgcccgggggtacatctccacccgcgtcggcatgggggaggccgccgcgatcttcatgaccgccacgccgcccggcagcgtggaggccttcccccagtccaacgccgtgatccaggacgaggagcgggacatccccgagcgcagctggaactccggctacgactggatcacggacttccccgggaagaccgtctggttcgtgcccagcatcaagtccggcaacgacatcgccaactgcctgcggaagaacgggaagcgcgtgatccagctcagccggaagaccttcgacaccgagtaccagaagacgaagaacaacgactgggactacgtcgtgaccaccgacatctccgagatgggcgcgaacttccgcgccgaccgggtgatcgacccccgccggtgcctgaagcccgtcatcctgaaggacgggcccgagcgcgtgatcctcgccggcccgatgcccgtcaccgtggccagcgcggcccagcggcgcggccggatcgggcgcaaccagaacaaggagggcgaccagtacgtgtacatggggcagcccctgaacaacgacgaggaccacgcccactggacggaggccaagatgctgctcgacaacatcaacacccccgagggcatcatcccggccctgttcgagcccgagcgcgagaagtccgcggccgtcgacggggagtaccggctgcgcggcgaggcccggaagaccttcgtggagctcatgcgccggggcgacctgcccgtgtggctgagctacaaggtcgcctccgaggggttccagtacagcgaccgccggtggtgcttcgacggcgagcgcaacaaccaggtgctcgaggagaacatggacgtggagatctggaccaaggagggggagcggaagaagctgcgcccccggtggctggacgcccgcacctactccgacccgctcgcgctgcgggagttcaaggagttcgccgccggccgccggagcgtcagcggcgacctgatcctcgagatcgggaagctgccccagcacctgacgctccgcgcccagaacgccctggacaacctggtgatgctccacaactccgagcagggcgggaaggcgtaccggcacgccatggaggagctgcccgacaccatcgagaccctgatgctcctggccctgatcgccgtgctcaccggcggggtcacgctgttcttcctgagcggcaagggcctcgggaagacctccatcggcctgctgtgcgtgaccgcgagctccgccctcctgtggatggccagcgtggagccccactggatcgccgcctccatcatcctggagttcttcctcatggtcctgctgatcccggagcccgaccgccagcggacgccccaggacaaccagctcgcgtacgtggtgatcgggctgctgttcatgatcctcacggtcgccgccaacgagatgggcctgctggagaccaccaagaaggacctcgggatcggctacgtggccgccgagaaccaccagcacgcgaccatgctggacgtggacctgcgcccggccagcgcctggacgctctacgccgtcgccaccaccgtgatcacccccatgatgcggcacacgatcgagaacaccaccgcgaacatctccctgaccgccatcgccaaccaggccgccatcctgatgggcctcgacaaggggtggcccatcagcaagatggacatcggcgtgcccctgctggcgctcgggtgctactcccaggtcaacccgctgacgctgaccgccgccgtgctcatgctggtggcccactacgcgatcatcggccccgggctgcaggccaaggccacccgcgaggcccagaagcgcaccgccgcgggcatcatgaagaaccccacggtcgacggcatcgtggccatcgacctcgaccccgtggtctacgacgccaagttcgagaagcagctggggcagatcatgctgctcatcctgtgcaccagccagatcctgctcatgcggaccacctgggccctgtgcgagtccatcacgctggccaccggcccgctcaccaccctgtgggaggggagccccggcaagttctggaacacgaccatcgcggtgtccatggccaacatcttccgcggcagctacctggccggggccggcctcgccttctccctgatgaagtccctcgggggcgggcggcgcgggaccggcgcgcagggggagaccctcggcgagaagtggaagcggcagctgaaccagctgtccaagagcgagttcaacacgtacaagcgcagcgggatcatggaggtggaccggtccgaggccaaggagggcctcaagcgcggggagaccaccaagcacgccgtcagccggggcaccgccaagctgcgctggttcgtggagcggaacctggtgaagcccgagggcaaggtcatcgacctggggtgcggccgcgggggctggtcctactactgcgcggggctcaagaaggtgaccgaggtgaagggctacacgaagggcgggcccggccacgaggagccgatccccatggccacctacgggtggaacctggtcaagctgcacagcggcaaggacgtgttcttcatgccgcccgagaagtgcgacaccctcctgtgcgacatcggggagtccagcccgaaccccaccatcgaggagggccggacgctgcgcgtgctcaagatggtcgagccctggctgcggggcaaccagttctgcatcaagatcctgaacccctacatgccgtccgtggtggagaccctcgagcagatgcagcgcaagcacgggggcatgctggtccggaaccccctgagccgcaactccacccacgagatgtactgggtgagctgcgggaccggcaacatcgtgtccgccgtcaacatgacgagccggatgctcctgaaccgcttcaccatggcccaccgcaagcccacctacgagcgggacgtggacctgggcgccgggacccgccacgtggcggtcgagcccgaggtggccaacctcgacatcatcggccagcggatcgagaacatcaagaacgagcacaagtccacgtggcactacgacgaggacaacccgtacaagacctgggcctaccacgggagctacgaggtcaagccctccggcagcgcctccagcatggtgaacggggtggtccgcctgctgaccaagccctgggacgtgatccccatggtgacccagatcgccatgacggacaccaccccgttcggccagcagcgggtcttcaaggagaaggtggacacccgcacgccccgggcgaagcgcggcaccacccagatcatggaggtgaccgccaagtggctctgggggttcctgtcccggaacaagaagccccgcatctgcacgcgggaggagttcacccgcaaggtccggagcaacgccgccatcggcgccgtgttcgtggacgagaaccagtggaacagcgcgaaggaggccgtcgaggacgagcgcttctgggacctggtgcaccgggagcgcgagctccacaagcaggggaagtgcgcgacctgcgtgtacaacatgatgggcaagcgggagaagaagctgggggagttcggcaaggccaagggctcccgcgcgatctggtacatgtggctgggggcccggttcctcgagttcgaggccctgggcttcatgaacgaggaccactggttcagccgcgagaactccctgagcggggtcgagggcgaggggctccacaagctgggctacatcctgcgggacatctccaagatcccgggcgggaacatgtacgccgacgacaccgccggctgggacacgcgcatcaccgaggacgacctccagaacgaggcgaagatcaccgacatcatggagcccgagcacgccctgctggccaccagcatcttcaagctcacgtaccagaacaaggtggtgcgcgtccagcggcccgccaagaacgggaccgtgatggacgtgatctcccgccgggaccagcgcggcagcggccaggtcgggacctacggcctgaacaccttcacgaacatggaggtgcagctgatccggcagatggagtccgaggggatcttcctccccagcgagctggagaccccgaacctggccgagcgcgtgctcgactggctggagaagcacggcgcggagcggctgaagcgcatggccatctccggggacgactgcgtcgtgaagcccatcgacgaccggttcgccaccgccctcaccgccctgaacgacatgggcaaggtgcgcaaggacatcccccagtgggagcccagcaagggctggaacgactggcagcaggtcccgttctgctcccaccacttccaccagctgatcatgaaggacgggcgggagatcgtggtgccctgccgcaaccaggacgagctcgtcggccgggcgcgcgtgagccagggggccggctggtccctgcgggagaccgcctgcctgggcaagagctacgcccagatgtggcagctcatgtacttccaccgccgggacctgcgcctggccgcgaacgccatctgctccgccgtgcccgtcgagtgggtgcccacgagccggaccacctggagcatccacgcccaccaccagtggatgaccacggaggacatgctctccgtgtggaaccgcgtctggatcgaggagaacccgtggatggaggacaagacccacgtgagctcctgggaggaggtgccctacctgggcaagcgcgaggaccagtggtgcggcagcctgatcgggctcaccgcgcgggccacctgggccacgaacatccaggtcgccatcaaccaggtgcgccggctgatcggcaacgagaactacctggactacatgacctccatgaagcgcttcaagaacgagagcgaccccgagggggccctctggtga

SEQ ID NO: 7983 - RNA, 9879 nt, synthetic construct
  misc_feature 1..9879: note = derived and/or modified CDS sequence (opt1) from DENV-1__KR028435__SS-prME
  source 1..9879: mol_type = other RNA
agcgtgaccatgctgctcatgctgatgcccaccgccctggccttccacctcaccacccggggcggggagccccacatgatcgtgtccaagcaggagcggggcaagagcctgctgttcaagacctccgccggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcggaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatctgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctgttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggccgactccgggtgcgtcatcaactggaagggccgggagctcaagtgcgggagcggcatcttcgtgacgaacgaggtgcacacctggaccgagcagtacaagttccaggcggacagcccgaagcgcctgtccgccgccatcggcaaggcctgggaggagggggtctgcggcatccggagcgccacccgcctggagaacatcatgtggaagcagatctccaacgagctcaaccacatcctgctggagaacgacatgaagttcaccgtggtggtcggggacgtggcgggcatcctcgcccaggggaagaagatgatccggccccagcccatggagcacaagtacagctggaagtcctggggcaaggccaagatcatcggcgccgacgtgcagaacacgaccttcatcatcgacgggcccaacaccccggagtgccccgacgaccagcgcgcgtggaacatctgggaggtcgaggactacggcttcgggatcttcaccacgaacatctggctgaagctgcgggacagctacacccaggtgtgcgaccaccgcctcatgtccgccgccatcaaggacagcaaggccgtgcacgccgacatgggctactggatcgagtccgagaagaacgagacctggaagctggcgcgggccagcttcatcgaggtcaagacctgcatctggcccaagtcccacacgctgtggagcaacggcgtgctcgagtccgagatgatcatccccaagatctacgggggcccgatcagccagcacaactaccgccccgggtacttcacccagaccgccggcccctggcacctggggaagctggagctcgacttcgacctgtgcgagggcaccacggtggtcgtggacgagcactgcggcaaccgggggccgtccctgcgcaccaccaccgtgacgggcaagatcatccacgagtggtgctgccggagctgcaccctgccgcccctccgcttccgcggggaggacggctgctggtacgggatggagatccgccccgtcaaggagaaggaggagaacctggtgaagtccatggtgagcgccggcagcggcgaggtcgactccttcagcctcgggctgctgtgcatctccatcatgatcgaggaggtgatgcggagccgctggtcccggaagatgctcatgaccggcaccctggccgtgttcttcctgctcatcatggggcagctgacgtggaacgacctgatccgcctctgcatcatggtcggcgcgaacgccagcgaccgcatggggatgggcaccacctacctggccctgatggccaccttcaagatgcggccgatgttcgccgtgggcctcctgttccgccggctgacgtcccgcgaggtgctcctgctgaccatcgggctcagcctggtcgcgtccgtggagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtcctgagcatcgtgtccctcttccccctgtgcctgagcacgacctcccagaagaccacctggctccccgtgctgctgggcagcctcgggtgcaagccgctgacgatgttcctgatcgccgagaacaagatctggggccggaagtcctggcccctcaacgaggggatcatggccgtcggcatcgtgagcatcctgctgagctccctcctgaagaacgacgtgcccctggccgggcccctcatcgccggcggcatgctgatcgcgtgctacgtcatcagcgggtccagcgccgacctgtccctcgagaaggccgccgaggtgagctgggaggaggaggccgagcactccggcgcgagccacaacatcctggtggaggtccaggacgacgggaccatgaagatcaaggacgaggagcgcgacgacaccctgaccatcctcctgaaggccaccctgctcgccatctccggcgtgtacccgctgagcatccccgccacgctgttcgtgtggtacttctggcagaagaagaagcagcggtccggggtcctctgggacacccccagcccgcccgaggtggagcgcgccgtgctggacgacggcatctaccggatcatgcagcgcggcctgctggggcggtcccaggtcggcgtgggggtgttccaggagaacgtcttccacaccatgtggcacgtgacccgcggcgcggtgctcatgtaccaggggaagcggctggagcccagctgggcctccgtcaagaaggacctgatcagctacggcggcgggtggcgcctccagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgggaggggaagatcgtgggcctgtacggcaacggggtggtcaccaccagcggcacctacgtgagcgccatcgcccaggccaaggcgtcccaggaggggccgctccccgagatcgaggacgaggtgttccgcaagcggaacctgacgatcatggacctgcaccccggcagcgggaagacccgccggtacctcccggccatcgtccgcgaggccatcaagcggaagctgcgcaccctgatcctcgcccccacccgcgtggtggcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtgcgggtcccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtggaggccttcccgcagagcaacgccgtcatccaggacgaggagggcgggatctccgagcgcagctggaactccggctacgagtggatcaccgacttccccgggaagaccgtgtggttcgtgcccagcatcaagtccggcaacgacatcgccaactgcctgcggaagaacgggaagcgcgtcatccagctcagccggaagaccttcgacacggagtaccagaagaccaagaacaacgactgggactacgtggtgaccaccgacatctccgagatgggcgcgaacttccgcgccgaccgggtcatcgacccccgccggtgcctgaagccggtgatcctgaaggacgggcccgagcgcgtgatcctcgccggccccatgcccgtcacggtggccagcgccgcgcagcggcgcggccggatcgggcgcaaccacaacaaggagggcgaccagtacatctacatggggcagccgctgaacaacgacgaggaccacgcccactggaccgaggccaagatgctgctcgacaacatcaacacccccgagggcatcatccccgccctgttcgagcccgagcgggagaagtccgccgcgatcgacggggagtaccgcctgcgcggcgaggcccggaagaccttcgtcgagctcatgcgccggggcgacctgccggtgtggctgagctacaaggtggccagcgaggggttccagtactccgaccgccggtggtgcttcgacggcgagcgcaacaaccaggtcctcgaggagaacatggacgtggagatctggacgaaggagggggagcggaagaagctgcgcccccggtggctggacgcccgcacctacagcgaccccctcgccctgcgggagttcaaggagttcgcggccggccgccggtccgtgagcggcgacctgatcctcgagatcgggaagctgccccagcacctgacccagcgcgcccagaacgccctcgacaacctggtcatgctgcacaactccgagcagggcgggcgggcgtaccgccacgccatggaggagctcccggacaccatcgagacgctgatgctgctcgccctgatcgccgtgctgaccggcggggtgaccctcttcttcctgagcggccggggcctggggaagacctccatcggcctcctgtgcgtcatggccagctccgtgctgctctggatggcgagcgtggagccccactggatcgccgcctccatcatcctggagttcttcctgatggtcctcctgatccccgagcccgaccgccagcggaccccgcaggacaaccagctggcctacgtggtgatcgggctcctgttcatgatcctgacggtcgccgcgaacgagatgggcctcctggagaccaccaagaaggacctggggatcggccacgtggccgtggagaaccaccaccacgccaccatgctcgacgtcgacctgcaccccgccagcgcctggacgctgtacgcggtggccaccaccatcatcacccccatgatgcgccacacgatcgagaacaccaccgccaacatctccctcaccgccatcgccaaccaggcggccatcctgatgggcctggacaaggggtggccgatcagcaagatggacatcggcgtgcccctcctggccctggggtgctactcccaggtcaaccccctcacgctgaccgccgcggtgctgatgctcgtggcccactacgccatcatcggccccgggctgcaggccaaggccacccgggaggcgcagaagcgcaccgccgccggcatcatgaagaacccgacggtcgacggcatcgtggccatcgacctggaccccgtggtctacgacgccaagttcgagaagcagctcgggcagatcatgctgctgatcctctgcaccagccagatcctgctgatgcgcaccacctgggcgctctgcgagtccatcacgctggccaccggccccctgaccaccctctgggaggggagccccggcaagttctggaacacgaccatcgccgtgtccatggccaacatcttccggggcagctacctggccggggcgggcctggccttcagcctcatgaagtccctcgggggcgggcgccggggcaccggcgcccagggggagaccctgggcgagaagtggaagcgccagctcaaccagctgagcaagtccgagttcaacacgtacaagcggagcgggatcatggaggtggaccgctccgaggccaaggagggcctgaagcgcggggagaccaccaagcacgcggtcagccgcggcaccgccaagctccggtggttcgtggagcgcaacctggtgaagccggagggcaaggtcatcgacctggggtgcggccgcgggggctggtcctactactgcgccgggctgaagaaggtgacggaggtgaagggctacaccaagggcgggcccggccacgaggagcccatccccatggccacctacgggtggaacctcgtcaagctgtacagcggcaaggacgtgttcttcatcccgcccgagaagtgcgacaccctgctctgcgacatcggggagtccagccccaaccccacgatcgaggagggccgcaccctgcgggtgctgaagatggtcgagccgtggctccgcggcaaccagttctgcatcaagatcctgaacccctacatgccctccgtggtggagaccctggagcagatgcagcggaagcacgggggcatgctcgtccgcaaccccctgagccggaactccacccacgagatgtactgggtgagctgcgggaccggcaacatcgtgtccgccgtcaacatgacgagccgcatgctgctcaaccggttcaccatggcgcaccgcaagccgacctacgagcgcgacgtggacctgggcgccgggacccggcacgtggccgtcgagcccgaggtggccaacctggacatcatcggccagcgcatcgagaacatcaagcacgagcacaagtccacgtggcactacgacgaggacaacccctacaagacctgggcctaccacgggagctacgaggtgaagccctccggcagcgcgagctccatggtcaacggggtggtcaagctcctgaccaagccgtgggacgtgatccccatggtgacccagatcgccatgacggacaccacccccttcggccagcagcgggtcttcaaggagaaggtggacacccgcacgcccaaggccaagcggggcaccgcccagatcatggaggtgaccgcccgctggctgtgggggttcctcagccggaacaagaagccgcgcatctgcacccgggaggagttcacgcgcaaggtccggtccaacgcggccatcggcgccgtgttcatcgacgagaaccagtggaacagcgccaaggaggcggtggaggacgagcgcttctgggacctggtccaccgggagcgcgagctgcacaagcaggggaagtgcgcgacctgcgtgtacaacatgatgggcaagcgggagaagaagctcggggagttcggcaaggccaagggctcccgcgccatctggtacatgtggctgggggcccggttcctggagttcgaggcgctcggcttcatgaacgaggaccactggttcagccgcgagaactccctgagcggggtggagggcgaggggctgcacaagctcggctacatcctgcgggacatctccaagatccccggcgggaacatgtacgccgacgacaccgccggctgggacacccgcatcacggaggacgacctgcagaacgaggccaagatcaccgacatcatggagcccgagcacgccctcctggcgaaggccatcttcaagctgacctaccagaacaaggtcgtgcgggtgcagcgcccggccaagaacgggaccgtcatggacgtgatcagccgccgggaccagcgcggctccggccaggtggggacgtacggcctcaacaccttcaccaacatggaggcccagctgatccggcagatggagagcgaggggatcttctcccccagcgagctggagacccccaacctcgccgagcgcgtcctggactggctggagaagtacggcgtggagcggctcaagcgcatggcgatctccggggacgactgcgtggtcaagcccatcgacgaccggttcgccacggccctgaccgccctgaacgacatgggcaaggtgcgcaaggacatcccgcagtgggagcccagcaagggctggaacgactggcagcaggtccccttctgctcccaccacttccaccagctcatcatgaaggacgggcgggagatcgtcgtgccctgccgcaaccaggacgagctggtgggccgggcccgcgtcagccagggggcgggctggagcctgcgggagaccgcctgcctcgggaagtcctacgcccagatgtggcagctgatgtacttccaccgccgggacctgcgcctcgccgcgaacgccatctgcagcgccgtgccggtggactgggtccccacctcccggacgacctggagcatccacgcccaccaccagtggatgaccaccgaggacatgctgtccgtgtggaaccgcgtgtggatcgaggagaacccctggatggaggacaagacgcacatcagctcctgggaggacgtcccctacctgggcaagcgggaggaccagtggtgcggcagcctcatcgggctgaccgcccgcgcgacctgggccaccaacatccaggtggccatcaaccaggtgcgccggctgatcggcaacgagaactacctcgactacatgacctccatgaagcgcttcaagaacgagagcgacccggagggggccctgtggtga

SEQ ID NO: 7984 - RNA, 9879 nt, synthetic construct
  misc_feature 1..9879: note = derived and/or modified CDS sequence (opt1) from DENV-1__JQ922548__SS-prME
  source 1..9879: mol_type = other RNA
agcgtgaccatgctgctcatgctgctgcccaccgccctcgccttccacctgaccacccggggcggggagccgcacatgatcgtgagcaagcaggagcggggcaagagcctcctgttcaagaccagcgccggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtcacctacgggacctgcagccagaccggcgagcaccggcgggacaagcggtccgtggccctggcgccccacgtgggcctggggctcgagacgcggaccgagacctggatgagctccgagggcgcctggcggcagatccagaaggtcgagacctgggccctgcgccacccggggttcacggtgatcgccctgttcctcgcgcacaccatcggcaccagcatcacccagaaggggatcatcttcatcctgctgatgctcgtgacgccctccatggccatgcggtgcgtcggcatcggcaaccgcgacttcgtggaggggctgagcggcgccacctgggtggacgtcgtgctggagcacgggtcctgcgtgaccaccatggcccggaacaagcccacgctcgacatcgagctgctgaagaccgaggtcaccaaccccgccgtgctccgcaagctgtgcatcgaggcgaagatcagcaacaccacgaccgactcccggtgcccgacccagggcgaggccaccctggtggaggagcaggacgccaacttcgtctgccgccggacgttcgtggaccgcggctgggggaacggctgcggcctgttcggcaaggggagcctgctgacctgcgccaagttcaagtgcgtgaccaagctcgagggcaagatcgtccagtacgagaacctgaagtactccgtgatcgtgaccgtccacacgggcgaccagcaccaggtggggaacgagaccaccgagcacggcaccatcgccaccatcacgccccaggcgcccatgagcgagatccagctgaccgactacggggccctcaccctggactgcagcccccggaccggcctggacttcaacgagatggtcctcctgacgatgaaggagaagtcctggctggtgcacaagcagtggttcctcgacctgccgctgccctggacctccggggccagcaccagccaggagacctggaaccgccaggacctcctggtgacgttcaagaccgcccaggccaagaagcaggaggtcgtggtgctgggctcccaggagggcgcgatgcacaccgccctcaccggggccacggagatccagaccagcggcaccaccacgatgttcgccgggcacctgaagtgccggctgaagatggacaagctcaccctgaagggcgcctcctacgtcatgtgcaccgggcccttcaagctggagaaggaggtggcggagacccagcacggcacggtgctggtccaggtgaagtacgagggcaccgacgccccctgcaagatcccgttcagcacccaggacgagaagggggtgacccagaacggccgcctcatcacggccaaccccatcgtcaccgacaaggagaagcccgtgaacatcgagaccgagcccccgttcggggagtcctacatcgtgatcggcgccggcgagaaggcgctgaagctgagctggttcaagaaggggtccagcatcggcaagatgttcgaggccaccgcccgcggggcccgccgcatggccatcctcggcgacacggcgtgggacttcgggtccatcggcggcgccttcaccagcgtcgggaagctggtgcaccaggtgttcggcaccgcctacggggtcctgttctccggcgtgagctggaccatgaagatcgggatcggcatcctcctgacgtggctgggcctcaactcccggagcacctccctgagcatgacctgcatcgccgtggggatggtcaccctgtacctcggcgtgatggtgcaggccgactccgggtgcgtcatcaactggaagggccgcgagctgaagtgcgggagcggcatcttcgtgacgaacgaggtgcacacctggaccgagcagtacaagttccaggcggactcccccaagcggctgagcgccgccatcggcaaggcctgggaggagggggtctgcggcatccgcagcgccacccggctcgagaacatcatgtggaagcagatctccaacgagctgaaccacatcctgctcgagaacgacatgaagttcaccgtggtggtcggggacgcgaacggcatcctgacgcaggggaagaagatgatccgcccccagcccatggagcacaagtacagctggaagtcctggggcaaggccaagatcatcggcgccgacgcccagaacaccaccttcatcatcgacgggccggacacccccgagtgccccgacgaccagcgggcgtggaacatctgggaggtggaggactacggcttcgggatcttcacgaccaacatctggctgaagctccgcgacagctacacccagatgtgcgaccaccggctgatgtccgccgccatcaaggacagcaaggccgtgcacgccgacatgggctactggatcgagtccgagaagaacgagacctggaagctgacgcgcgcgagcttcatcgaggtcaagacctgcacctggccccggtcccacaccctctggagcaacggcgtgctggagtccgagatgatcatcccgaagatctacgggggccccatcagccagcacaactaccgccccgggtacttcacgcagaccgccggcccgtggcacctggggaagctcgagctggacttcaacctgtgcgagggcaccaccgtggtcgtggacgagcactgcggcaacgggggcgcctccctcgggacgaccaccgtgaccggcaagatcatccacgagtggtgctgccggagctgcacgctgccgcccctgcgcttcctcggggaggacggctgctggtacggcatggagatccggcccgtcaaggagaaggaggagaacctgttccgctccatggtgagcgccgggtccggcgaggtggacagcttcagcctggggctcctgtgcgtctccatcatgatcgaggaggtgatgcggagccgctggtcccggaagatgctgatgaccggcaccctcgccgtgttcttcctgctgatcatggggcagctcacctggaacgacctgatccgcctgtgcatcatggtcggcgcgaacgccagcgaccgcatcggcatggggacgacctacctcgccctgatggccaccttcaagatgcggccgatgttcgccgtgggcctcctcttccgccggctgacctcccgcgaggtgctgctcctgacgatcgggctgagcctcgtcgcgtccgtggagctgcccaacagcctggaggagctcggcgacggcctggccatggggatcatgatgctgaagctcctgaccgacttccagtcccaccagctgtggaccaccctcctgagcctgacgttcatcaagaccaccctctccctggactacgcctggaagaccatcgccatggtgctgagcatcgtctccctcttccccctgtgcctgagcacgacctcccagaagaccacctggctccccgtgctgctgggcagcttcgggtccaagccgctcaccatgttcctgatcacggagaacaagatctggggccgcaagagctggcccctgaacgaggggatcatggcggtcggcatcgtgtccatcctcctgagcagcctgcccaagaacgacgtgcccctcgccggcccgctgatcgccgggggcatgctgatcgcctgctacgtcatctccgggagctccgccgacctcagcctggagcgcgcggccgaggtgtcctgggaggaggaggccgagcacagcggcgcctcccacaacatcctggtggaggtccaggacgacgggaacatgaagatcaaggacgaggagcgggacgacagcctcaccatcctgctgaaggccaccctcctggcggtgtccggcgtgtaccccatgagcatccccgccaccctgttcgtctggtacttctggcagaagaagaagcagcgctccggcgtgctctgggacacgcccagcccgcccgaggtggtccgggccgtgctggacgacgggatctaccgcatcctgcagcggggcctgctcgggcgctcccaggtgggcgtcggggtgttccaggacggcgtgttccacaccatgtggcacgtcacccggggcgccgtgctgatgtaccaggggaagcgcctggagcccagctgggcctccgtgaagaaggacctcatcagctacggcgggggctggcggttccaggggtcctggaacaccggcgaggaggtccaggtgatcgcggtggagcccggcaagaacccgaagaacgtccagacgacccccgggaccttcaagacccccgagggcgaggtgggggccatcgccctggacttcaagcccggcacgagcggctccccgatcgtgaaccgcgaggggaagatcgtcggcctgtacgggaacggcgtggtgaccaccagcgggacctacgtcagcgccatcgcccaggcgaaggcctcccaggagggccccctccccgagatcgaggacgaggtgttcaagaagcggaacctgacgatcatggacctgcacccgggcagcgggaagacccgccggtacctccccgccatcgtgcgcgaggccatcaagcggaagctgcgcaccctgatcctcgcgcccacccgcgtcgtggcctccgagatggccgaggccctgaagggcatgcccatccggtaccagacgaccgccgtcaagagcgagcacaccgggcgcgagatcgtcgacctgatgtgccacgcgaacttcaccatgcggctcctgtccccggtgcgcgtgcccaactacaacatgatcatcatggacgaggcccacttcacggaccccgccagcatcgccgcccggggctacatctccacccgcgtcgggatgggcgaggcggccgccatcttcatgaccgccacgccgcccggcagcgtggaggccttcccccagtccaacgcggtgatccaggacgaggagcgggacatccccgagcgcagctggaactccgggtacgactggatcacggacttccccggcaagaccgtctggttcgtgcccagcatcaagtccgggaacgacatcgccaactgcctgcggaagaacggcaagcgcgtgatccagctcagccggaagaccttcgacaccgagtaccagaagacgaagaacaacgactgggactacgtcgtgaccaccgacatctccgagatgggggccaacagccgcaccgaccgggtgatcgacccccgccggtgcctgaagcccgtcatcctgaaggacggccccgagcgcgtgatcctcgccggcccgatgcccgtgacggcggcctccgccgcccagcggcgcgggcggatcggccgcaaccagaacaaggagggggaccagtacatctacatgggccagcccctgaacaacgacgaggaccacgcccactggaccgaggcgaagatgctgctcgacaacatcaacacccccgaggggatcatcccggccctgttcgagcccgagcgcgagaagtccgccgccatcgacggcgagtaccggctgcgcggcgaggcccggaagaccttcgtcgagctcatgcgccgcggggacctgcccgtgtggctgtcctacaaggtcgcgagcgagggcttccagtacagcgaccgccggtggtgcttcgacggggagcgcaacaaccaggtgctcgaggagaacatggacgtggagatctggacgaaggagggcgagcggaagaagctgcgcccccggtggctggacgcccgcacctactccgacccgctcgccctgcgggagttcaaggagttcgccgccggccgccggagcgtctccggggacctgatcctcgagatcggcaagctgccccagcacctgaccctccgcgcgcagaacgccctggacaacctggtgatgctccacaacagcgagcagggcgggaaggcctaccggcacgccatggaggagctgcccgacaccatcgagaccctgatgctcctggcgctgatcgccgtgctcaccggcggggtcaccctgttcttcctgtccgggaaggggctcggcaagaccagcatcgggctgctgtgcgtgatggcctccagcgtgctcctgtggatggcctccgtcgagccccactggatcgccgcgagcatcatcctggagttcttcctcaaggagctgctgatcccggacgccgacggccagcgcacgccccaggacaaccagctcgcctacgtggtgatcgggctgctgttcatgatcctcacggtcgccgccaacgagatgggcctgctggagaccaccaagaagaacctcggcatcgggcacgtggtggcggagaaccaccaccacgccaccatgctggacatcgacctgcaccccgcctccgcctggacgctctacgccgtcgcgaccaccatcatcaccccgatgatgcggcacacgatcgagaacaccaccgccaacatcagcctgaccgccatcgccaaccaggccgcgatcctgatgggcctcgacaaggggcgccccatctccaagatggacatcggcgtgcccctgctggccctcgggtgctacagccaggtgaaccccctgacgctgaccgccgccgtcctcatgctggtggcgcactacgccatcatcggcccgggcctgcaggccaaggccacccgggaggcccagaagcgcaccgcggccgggctcatgaagaaccccacggtggacggcatcgccgccatcgacctggaccccgtcgtgtacgacgccaagttcgagaagcagctggggcagatcatgctcctgatcctgtgcacctcccagatcctcctgatgcgcaccacctgggcgctgtgcgagagcatcacgctcgccaccggccccctgaccaccctgtgggagggctccccggggaagttctggaacacgaccatcgccgtgagcatggccaacatcttccggggctcctacctcgccggggcgggcctggccttcagcctgatgaagtccctcgggggcggccgccgggggaccggcgcccagggggagaccctgggcgagaagtggaagcgccagctgaaccagctctccaagagcgagttcaacacgtacaagcggtccgggatcatggaggtcgaccgcagcgaggccaaggagggcctgaagcggggcgagaccaccaagcacgcggtgtcccgcgggaccgccaagctgcggtggttcgtggagcgcaacctggtcaagcccgagggcaaggtgatcgacctcgggtgcggccgcgggggctggagctactactgcgccggcctgaagaaggtgacggaggtcaaggggtacaccaagggcgggcccggccacgaggagcccatcccgatggccacctacgggtggaacctggtgaagctccactccggcaaggacgtgttcttcacgccgcccgagaagtgcgacaccctgctgtgcgacatcggcgagagctcccccaacccgacgatcgaggaggggcgcaccctccgggtcctgaagatggtggagccctggctgcgcggcaaccagttctgcatcaagatcctcaacccctacatgcccagcgtggtcgagaccctggagcagatgcagcggaagcacgggggcatgctggtgcgcaacccgctctcccggaacagcacccacgagatgtactgggtgtcctgcgccacgggcaacatcgtcagcgcggtgaacatgacctcccgcatgctgctgaaccggttcaccatggcccaccgcaagcccacctacgagcgcgacgtggacctcggggccggcacgcggcacgtcgccgtggagcccgagatcgccaacctggacatcatcgggcagcgcatcgagaacatcaagaacgagcacaagagcacctggcactacgacgaggacaacccctacaagacctgggcgtaccacggcacctacgaggtgaagccgtccgggagcgcctccagcatggtcaacggcgtggtgcggctgctcacgaagccctgggacgtcatccccatggtgacccagatcgccatgaccgacaccacgcccttcggccagcagcgcgtgttcaaggagaaggtcgacacccggaccccgcgccccaagcgggggaccgcccagatcatggaggtgacggcccgctggctgtggggcttcctgagccggaacaagaagccccgcatctgcacccgggaggagttcacccgcaaggtccggtccaacgcggccatcggggccgtgttcgtggacgagaaccagtggaacagcgccaaggaggcggtcgaggacgagcgcttctgggacctcgtgcaccgggagcgcgagctgcacaagcagggcaagtgcgcgacctgcgtgtacaacatgatggggaagcgggagaagaagctgggcgagttcggcaaggccaaggggtcccgcgccatctggtacatgtggctcggcgcccggttcctggagttcgaggcgctggggttcatgaacgaggaccactggttcagccgcgagaactccctcagcggcgtcgagggggagggcctgcacaagctgggctacatcctccgggacatctccaagatccccgggggcaacatgtacgccgacgacacggccgggtgggacacccgcatcaccgaggacgacctgcagaacgaggccaagatcaccgacatcatggagcccgagcacgccctgctcgcgacgagcatcttcaagctgacctaccagaacaaggtggtgcgcgtccagcggcccgccaagtccggcaccgtgatggacgtgatcagccgccgggaccagcgcggctccgggcaggtcggcacctacgggctgaacacgttcaccaacatggaggtgcagctcatccggcagatggagagcgagggcatcttctcccccagcgagctggagaactccaacctggccgagcgcgccctcgactggctggagaagcacggggtggagcggctgaagcgcatggccatcagcggcgacgactgcgtcgtgaagccgaccgacgaccggttcgcgaccgccctcacggccctgaacgacatgggcaaggtgcgcaaggacatcccccagtgcgagccctccaaggggtggaacgactggcagcaggtccccttctgcagccaccacttccaccagctgatcatgaaggacggccgggagatcgtggtgccgtgccgcaaccaggacgagctcgtcgggcgggcccgcgtgagccagggcgccgggtggtccctgcgggagaccgcgtgcctgggcaagagctacgcccagatgtggcagctcatgtacttccaccgccgggacctgcgcctggccgccaacgcgatctgctccgccgtgcccgtcaactgggtgcccaccagccggaccacctggtccatccacgcccaccaccagtggatgacgaccgaggacatgctcagcgtgtggaaccgcgtctggatcgaggagaacccctggatggaggacaagacccacgtgtccagctgggccgacgtgccgtacctgggcaagcgcgaggaccagtggtgcgggtccctgatcggcctcgccgcgcgggccacctgggccacgaacatccaggtcgccctgaaccaggtgcgccggctgatcgggaacgagaactacctcgactacatgaccagcatgaagcgcttcaagaacgagtccgaccccgagggcgccctgtggtga

SEQ ID NO: 7985 - RNA, 9879 nt, synthetic construct
  misc_feature 1..9879: note = derived and/or modified CDS sequence (opt1) from DENV-1__JQ922544__SS-prME
  source 1..9879: mol_type = other RNA
agcgtgaccatgctgctcatgctgctgcccaccgccctcgccttccacctgaccacccggggcggggagccccacatgatcgtgtccaagcaggagcggggcaagagcctcctgttcaagacctccgccggggtgaacatgtgcaccctgatcgccatggacctgggcgagctctgcgaggacacgatgacctacaagtgcccccggatcaccgaggccgagcccgacgacgtggactgctggtgcaacgccaccgacacctgggtgacctacgggacctgcagccagaccggcgagcaccggcgggacaagcggtccgtggccctggcgccccacgtgggcctggggctcgagacccgcaccgagacctggatgagctgcgagggcgcctggaagcagatccagaaggtcgagatctgggccctgcggcaccccgggttcaccgtgatcgccctgttcctcgcgcacgccatcggcacgtccatcacccagaaggggatcatcttcatcctgctgatgctcgtgacccccagcatggccatgcgctgcgtcggcatcggcaaccgggagttcgtggaggggctgtccggcgccacctgggtggacgtcgtgctggagcacgggagctgcctccacacgatggcccagaacaagcccaccctggacatcgagctgctcaagaccgaggtgaccaaccccgcggtcctgcgcaagctgtgcatcgaggccaagatctccaacacgaccaccgacagccggtgccccacccagggcgaggccacgctcgtggaggagcaggacgccaacttcgtgtgccgccggaccttcgtcgaccgcggctgggggaacggctgcgggctgttcggcaaggggtccctgctgacctgcgccaagttcaagtgcgtgaccaagctggagggcaagatcgtgcagtacgagaacctgaagtacagcgtcatcgtgacggtgcacaccggcgaccagcaccaggtcgggaacgagaccaccacgcacggcaccatcgcgaccatcacgccccaggcccccacctccgagatccagctcacggactacggggccctgaccctggactgcagcccccggaccggcctcgacttcaacgagatggtgctgctgaccatgaaggagaagtcctggctcgtccacaagcagtggttcctggacctgccgctcccctggacgagcggggcctccaccagccaggagacctggaaccgccaggacctgctggtgaccttcaagacggcccacgcgaagaagcaggaggtggtcgtgctcggcagccaggagggcgccatgcacaccgccctgaccggggccaccgagatccagacgtccggcaccaccaccatcttcgccgggcacctgaagtgccggctcaagatggacaagctgacgctgaagggcatgagctacgtgatgtgcaccgggtccttcaagctggagaaggaggtcgcggagacccagcacggcaccgtgctcgtgcaggtcaagtacgagggcacggacgccccctgcaagatccccttcagcacccaggacgagaagggggtgacccagaacggccgcctgatcaccgccaacccgatcgtgacggacaaggagaagcccgtcaacatcgaggccgagccgcccttcggggagtcctacatcgtggtgggcgcgggcgagaaggccctgaagctcagctggttcaagaaggggtccagcatcggcaagatgttcgaggccaccgcccgcggggcccgccggatggcgatcctgggcgacaccgcctgggacttcgggtccatcggcggcgtcttcaccagcgtggggaagctggtgcaccaggtcttcggcacggcctacggggtcctcttctccggcgtgagctggatcatgaagatcgggatcggcatcctgctgacctggctcggcctgaactcccgcagcacctccctgagcatgacctgcatcgccgtcgggatggtgacgctctacctgggcgtgatggtccaggccgactccgggtgcgtgatcaactggaagggccgcgagctgaagtgcgggagcggcatcttcgtgaccaacgaggtccacacctggaccgagcagtacaagttccaggcggactccccgaagcggctcagcgccgccatcggcaaggcctgggaggagggggtgtgcggcatccgcagcgccacgcggctggagaacatcatgtggaagcagatctccaacgagctgaaccacatcctcctggagaacgacatgaagttcaccgtggtcgtgggggacgcgaacggcatcctggcccaggggaagaagatgatccgcccccagcccatggagcacaagtacagctggaagtcctggggcaaggccaagatcatcggcgccgacatccagaacaccaccttcatcatcgacgggcccgacaccccggagtgccccgacgaccagcgggcgtggaacatctgggaggtggaggactacggcttcgggatcttcacgaccaacatctggctcaagctgcgcgacagctacacccagatgtgcgaccaccggctgatgtccgccgccatcaaggacagcaaggccgtccacgccgacatgggctactggatcgagtccgagaagaacgagacctggaagctcgcgcgcgccagcttcatcgaggtgaagacgtgcatctggcccaagtcccacaccctgtggagcaacggcgtgctggagtccgagatgatcatccccaagatctacgggggcccgatcagccagcacaactaccggcccgggtacttcacccagaccgccggcccctggcacctcgggaagctggagctggacttcgacctctgcgagggcacgaccgtcgtggtggaggagcactgcggcaaccgcgggccgtccctgcggaccaccacggtcaccggcaagatcatccacgagtggtgctgccgcagctgcaccctgccgcccctccggttcaagggggaggacggctgctggtacgggatggagatccgccccgtgaaggagaaggaggagaacctggtgcggtccatggtcagcgccggctccggcgaggtggacagcttcagcctggggctcctgtgcgtgtccatcatgatcgaggaggtcatgcgcagccggtggtcccgcaagatgctgatgaccggcacgctcgccgtgttcctgctgctcatcatggggcagctgacctggaacgacctgatccggctctgcatcatggtgggcgcgaacgccagcgaccgcatggggatgggcaccacctacctggccctgatggccacgttcaagatgcgcccgatgttcgccgtcggcctcctgttccggcgcctgacctcccgggaggtgctcctgctgaccatcgggctcagcctggtggcgtccgtcgagctgcccaacagcctcgaggagctgggcgacgggctggccatgggcatcatgatgctcaagctgctgaccgacttccagtcccaccagctctggacgaccctgctgagcctcaccttcatcaagaccacgctgtccctggactacgcctggaagaccatggccatggtgctcagcatcgtctccctgttccccctgtgcctcagcaccacctcccagaagacgacctggctgcccgtgctgctcggcagcttcgggtgcaagccgctgaccatgttcctgatcaccgagaacaagatctggggccgcaagtcctggcccctcaacgaggggatcatggcggtgggcatcgtcagcatcctgctgtccagcctcctgaagaacgacgtgcccctggccgggcccctcatcgccggcggcatgctgatcagcttcttcgtgatctccgggagctccgccgacctgagcctcgagaaggccgcggaggtctcctgggaggaggaggccgagcacagcggcacgtcccacaacatcctggtggaggtgcaggacgacgggaccatgaagatcaaggacgaggagcgggacgacaccctgaccatcctcctgaaggccaccctgctcgccgtcagcggcgtgtacccgatgtccatccccgccacgctgttcgtgtggtacttctggcagaagaagaagcagcgcagcggggtcctgtgggacacccccagcccgcccgaggtggagcgggcggtgctggacgacggcatctaccgcatcctccagcggggcctgctggggcgcagccaggtcggcgtgggggtgttccaggacggcgtcttccacaccatgtggcacgtgacccgcggggccgtgctcatgtaccagggcaagcgcctggagccctcctgggccagcgtcaagaaggacctgatctcctacggcgggggctggcggttccaggggagctggaacacgggcgaggaggtccaggtgatcgccgtcgagcccgggaagaaccccaagaacgtgcagaccacccccggcaccttcaagacgcccgagggcgaggtgggggccatcgcgctcgacttcaagcccggcacctccgggagccccatcgtcaaccgcgagggcaagatcgtgggcctgtacgggaacggcgtggtcaccacctccgggacgtacgtgagcgccatcgcccaggccaaggccagccaggagggcccgctgcccgagatcgaggacgaggtgttccggaagcgcaacctcaccatcatggacctgcaccccgggtccggcaagacccggcgctacctgccggcgatcgtccgggaggccatcaagcgcaagctccggaccctgatcctggcccccacgcgcgtggtggccagcgagatggcggaggccctcaagggcatgcccatccgctaccagaccaccgccgtcaagtccgagcacaccgggcgggagatcgtggacctgatgtgccacgccacgttcaccatgcgcctgctcagccccgtgcgggtcccgaactacaacatgatcatcatggacgaggcccacttcaccgaccccgcgtccatcgccgcccgcggctacatcagcacccgggtggggatgggcgaggccgccgcgatcttcatgacggccacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctgtcccgcaagacgttcgacaccgagtaccagaagaccaagaacaacgactgggactacgtggtgaccacggacatcagcgagatgggggcgaacttccgggccgaccgcgtcatcgacccgcggcgctgcctcaagcccgtgatcctgaaggacggccccgagcgggtgatcctggccgggcccatgccggtcaccgtggcctccgcggcccagcgccggggccgcatcggccggaaccagaacaaggagggggaccagtacgtcaacatgggccagcccctcaacaacgacgaggaccacgcccactggaccgaggccaagatgctgctggacaacatcaacacccccgaggggatcatccccgccctcttcgagccggagcgcaagaagtccgcggccgtggacggcgagtaccgcctgcgcggggaggcccgcaagacgttcgtggagctgatgcggcgcggcgacctccccgtctggctgtcctacaaggtggccagcgagggcttccagtactccgaccggcgctggtgcttcgacggggagcggaacaaccaggtgctggaggagaacatggacgtcgagatctggaccaaggagcgcgagcggaagaagctccgcccccggtggctggacgcccgcacctacagcgaccccctggcgctccgggagttcaaggagttcgccgccggccgccggagcgtgtccggggacctgatcctggagatcggcaagctcccgcagcacctgaccctgcgcgcccagaacgccctcgacaacctggtgatgctgcacaacagcgagcagggcgggaaggcgtaccggcacgccatggaggagctccccgacacgatcgagaccctgatgctgctcgccctgatcgccgtcctgaccggcggggtgaccctcttcttcctgtccggcaaggggctgggcaagaccagcatcggcctcctgtgcgtgatggcgtccagcgccctgctctggatggcctccgtcgagccccactggatcgccgccagcatcatcctggagttcttcctgatggtgctcctgatccccgagccggaccgccagcggacgccccaggacaaccagctggcgtacgtggtcatcgggctcctgttcatgatcctgaccgtggccgccaacgagatgggcctcctggagaccaccaagaaggacctggggatcggccacgtggccgccgagaaccaccaccacgcgacgatgctcgacgtcgacctgcgccccgcctccgcctggaccctgtacgccgtggccaccaccatcatcacgccgatgatgcggcacaccatcgagaacaccaccgcgaacatcagcctcacggccatcgccaaccaggccgccatcctgatggggctggacaagggctggcccatctccctcatggacatcggcgtgcccctgctggcgctcgggtgctacagccaggtcaaccccctgaccctgaccgccgccgtgctcatgctggtggcccactacgcgatcatcggcccggggctgcaggccaaggccacccgcgaggcccagaagcgcacggccgcgggcatcatgaagaaccccaccgtcgacgggatcgtggccatcgacctcgaccccgtggtctacgacgccaagttcgagaagcagctgggccagatcatgctgctcatcctgtgcacctcccagatcctgctcatgcggaccacgtgggccctgtgcgagagcatcaccctggccaccggccccctcaccacgctgtgggaggggtccccgggcaagttctggaacaccaccatcgcggtgagcatggccaacatcttccgcgggtcctacctggccggcgccggcctcgccttcagcctgatgaagtccctcgggggcgggcggcgcgggaccggggcgcagggcgagacgctcggcgagaagtggaagcggcagctgaaccagctgagcaagagcgagttcaacatctacaagcgctccgggatcatggaggtggaccggagcgaggccaaggagggcctgaagcgcggggagaccaccaagcacgccgtctcccggggcaccgccaagctccgctggttcgtggagcggaacctggtgaagcccgaggggaaggtcatcgacctgggctgcggccgcgggggctggagctactactgcgcggggctcaagaaggtgacggaggtgaagggctacaccaagggcgggcccggccacgaggagcccatcccgatggccacctacgggtggaacctggtcaagctgcactccggcaaggacgtgttcttcacgccgcccgagaagtgcgacacgctcctgtgcgacatcggggagagctcccccaacccgaccatcgaggagggccggaccctgcgcgtgctcaagatggtcgagccctggctgcgggggaaccagttctgcatcaagatcctgaacccctacatgcccagcgtggtggagaccctcgagcagatgcagcgcaagcacggcggcatgctggtccggaacccgctgtcccgcaacagcacccacgagatgtactgggtgtcctgcgggacgggcaacatcgtgagcgccgtcaacatgacctcccggatgctcctgaaccgcttcaccatggcccaccgcaagcccacctacgagcgggacgtggacctgggggccggcacgcgccacgtggcggtcgagcccgaggtggccaacctcgacatcatcggccagcggatcgagaacatcaagaacgagcacaagagcacctggcactacgacgaggacaacccctacaagacctgggcctaccacgggtcctacgaggtgaagccgagcggctccgccagctccatggtcaacggggtggtccgcctgctgaccaagccctgggacgtgatccccatggtgacgcagatcgccatgaccgacaccacccccttcggccagcagcgggtcttcaaggagaaggtggacacgcgcaccccgcgggcgaagcgcgggaccgcccagatcatggaggtgaccgccaagtggctctggggcttcctgagccggaacaagaagccccgcatctgcacgcgggaggagttcacccgcaaggtccggagcaacgccgccatgggcgcggtgttcgtggacgagaaccagtggaactccgccaaggaggccgtcgaggacgagcgcttctgggacctggtgcaccgggagcgcgagctccacaagcaggggaagtgcgcgacctgcgtgtacaacatgatgggcaagcgggagaagaagctgggggagttcggcaaggcgaaggggagccgcgccatctggtacatgtggctgggcgcccggttcctcgagttcgaggccctgggcttcatgaacgaggaccactggttctcccgcgagaacagcctgtccggggtcgagggcgaggggctccacaagctgggctacatcctgcgggacatcagcaagatccccgggggcaacatgtacgccgacgacaccgcgggctgggacacgcgcatcaccgaggacgacctccagaacgaggccaagatcaccgacatcatggagccggagcacgccctgctggccacctccatcttcaagctcacgtaccagaacaaggtggtgcgcgtccagcggcccgccaagagcgggaccgtgatggacgtgatctcccgccgggaccagcgcggcagcgggcaggtcggcacctacggcctgaacaccttcacgaacatggaggtgcagctgatccggcagatggagtccgaggggatcttcctccccagcgagctggagacccccaacctggcggagcgcgtgctcgactggctggagaagcacggcgccgagcggctgaagcgcatggccatctccggggacgactgcgtcgtgaagccgatcgacgaccggttcgccaccgccctcaccgcgctgaacgacatgggcaaggtgcgcaaggacatcccccagtgggagcccagcaaggggtggaacgactggcagcaggtccccttctgctcccaccacttccaccagctgatcatgaaggacggccgggagatcgtggtgccgtgccgcaaccaggacaagctcgtcggccgggcccgcgtgagccagggggccggctggtccctgcgggagacggcctgcctgggcaagagctacgcccagatgtggcagctcatgtacttccaccgccgggacctgcgcctggcggccaacgccatctgcagcgccgtgcccgtcgactgggtgcccacctcccggaccacctggagcatccacgcgcaccaccagtggatgacgaccgaggacatgctctccgtgtggaacaaggtctggatcgaggagaacccctggatggaggacaagacccacgtgagctcctgggaggacgtgccgtacctgggcaagcgcgaggaccagtggtgcgggagcctgatcggcctcaccgcccgcgccacctgggccacgaacatccaggtcgccatcaaccaggtgcggcgcctgatcggcaacgagaactacctggactacatgacctccatgaagcggttcaagaacgagagcgaccccgagggggcgctctggtga

SEQ ID NO: 7986 - RNA, 9879 nt, synthetic construct
  misc_feature 1..9879: note = derived and/or modified CDS sequence (opt1) from DENV-1__JQ922546__SS-prME
  source 1..9879: mol_type = other RNA
agcgtggccatgctgctcatgctgctgcccaccgccctcgccttccacctgaccacccggggcggggagccccacatgatcgtgagcaagcaggagcggggcaagagcctgctgttcaagacctccgccggggtgaacatgtgcaccctgatcgccatggacctgggcgagctctgcgaggacaccatgacgtacaagtggccccggatcaccgaggccgagcccgacgacgtggactgctggtgcaacgccaccgacacctgggtcacctacgggacctgcagccagaccggcgagcaccggcgggacaagcggtccgtggcgctggcgccccacgtgggcctggggctcgagacccggacggagacctggatgagctccgagggcgcctggaagcagatccagaaggtcgagacctgggccctgcggcaccccgggttcaccgtgatcgccctgttcctcgcccacgccatcggcacgagcatcacccagaaggggatcatcttcatcctgctgatgctcgtgaccccctccatggccatgcgctgcgtcggcatcggcaaccgggacttcgtggaggggctgagcggcgccacctgggtggacgtcgtgctggagcacgggtcctgcgtgacgaccatggcgaagaacaagcccaccctcgacatcgagctgctgaagaccgaggtcacgaaccccgccgtgctccgcaagctgtgcatcgaggccaagatcagcaacaccaccaccgactcccggtgccccacgcagggcgaggccaccctggtggaggagcaggacgccaacttcgtctgccgccggaccttcgtggaccgcggctgggggaacggctgcggcctcttcggcaaggggagcctgctgacctgcgcgaagttcaagtgcgtgacgaagctcgagggcaagatcgtccagtacgagaacctgaagtactccgtgatcgtgaccgtccacaccggcgaccagcaccaggtggggaacgagaccacggagcacggcaccatcgccatcatcacgccccaggcccccaccagcgagatccagctgaccgactacggggccctcacgctggactgcagcccccggaccggcctggacttcaacgagatggtcctcctgaccatgaaggagaagtcctggctggtgcacaagcagtggttcctcgacctgccgctgccctggacctccggggccagcacgagccaggagacctggaaccgccaggacctcctggtgaccttcaagaccgcgcacgccaagaagcaggaggtcgtggtgctgggctcccaggagggcgccatgcacacggccctcaccggggccaccgagatccagaccagcggcacgaccaccatcttcgcggggcacctgaagtgccggctgaagatggacaagctcaccctgaagggcatgtcctacgtcatgtgcacggggagcttcaagctggagaaggaggtggccgagacccagcacggcaccgtgctggtccaggtgaagtacgagggcaccgacgccccctgcaagatccccttctccatccaggacgagaagggggtgacgcagaacggccgcctcatcaccgccaacccgatcgtcaccgacaaggagaagcccgtgaacatcgagaccgagccgcccttcggggagagctacatcgtggtcggcgcgggcgagaaggccctgaagctgtcctggttcaagaaggggagctccatcggcaagatgttcgaggccacggcccgcggggcccgccggatggcgatcctcggcgacaccgcctgggacttcgggagcatcggcggcgtgttcacctccgtggggaagctggtccaccaggtgttcggcaccgcctacggggtgctgttcagcggcgtctcctggacgatgaagatcgggatcggcatcctcctgacctggctgggcctcaacagccgctccaccagcctgtccatgacctgcatcgccgtggggatggtgacgctgtacctcggcgtcatggtgcaggccgacagcgggtgcgtgatcaactggaagggccgcgagctgaagtgcgggtccggcatcttcgtcaccaacgaggtgcacacctggaccgagcagtacaagttccaggcggacagcccgaagcggctgagcgccgccatcggcaaggcctgggaggagggggtgtgcggcatccgctccgccacgcggctcgagaacgtcatgtggaagcagatcagcaacgagctgaaccacatcctgctcgagaacgacatgaagttcaccgtggtggtcggggacgtgaacggcatcctggcgcaggggaagaagatgatccgcccccagcccatggagcacaagtactcctggaagtcctggggcaaggccaagatcatcggcgccgacatccagaacaccaccttcatcatcgacgggcccgacaccccggagtgccccgacgaccagcgggcctggaacatctgggaggtggaggactacggcttcgggatcttcacgaccaacatctggctgaagctccgcgactcctacacccaggtctgcgaccaccggctgatgagcgcggccatcaaggactccaaggccgtgcacgccgacatgggctactggatcgagagcgagaagaacgagacctggaagctggcccgcgcgtccttcatcgaggtgaagacgtgcacctggcccaagagccacaccctctggtccaacggcgtcctggagagcgagatgatcatccccaagatctacgggggcccgatctcccagcacaactaccggcccgggtacttcacccagacggccggcccctggcacctggggaagctcgagctggacttcgacctgtgcgagggcaccaccgtggtggtcgacgagcactgcggcaaccgcgggccgagcctccggaccacgaccgtgaccggcaagatcatccacgagtggtgctgccgctcctgcaccctgccgcccctgcggttcaagggggaggacggctgctggtacgggatggagatccgccccgtgaaggagaaggaggagaacctcgtccggagcatggtgtccgccggcagcggcgaggtggacagcttctccctggggctgctctgcgtcagcatcatgatcgaggaggtgatgcgctcccggtggagccgcaagatgctgatgacgggcaccctggccgtgttcttcctcctgatcatggggcagctgacctggaacgacctcttccggctgtgcatcatggtcggcgccaacgcgtccgaccgcatggggatgggcaccacgtacctggccctcatggccaccttcaagatgcgcccgatgttcgccgtggggctgctgttccggcgcctcaccagccgggaggtcctgctgctcaccatcgggctgtccctggtggccagcgtggagctccccaactccctggaggagctgggcgacgggctcgccatgggcatcatgatgctgaagctgctcacggacttccagagccaccagctgtggaccaccctgctctccctgaccttcatcaagacgaccctgagcctcgactacgcctggaagaccatggccatggtcctgtccatcgtgagcctgagccccctctgcctgagcaccacgtcccagaagaccacctggctgcccgtgctcctgggcagcttcgggtgcaagccgctgaccatgttcctcatcacggagaacaagatctggggccgcaagtcctggcccctgaacgaggggatcatggccgtcggcatcgtgagcatcctgctcagctccctgctgaagaacgacgtgcccctcgcggggcccctgatcgccggcggcatgctgatcgcctgctacgtcatcagcgggtccagcgccgacctctccctggagaaggccgcggaggtgagctgggaggaggaggccgagcactccggcgccagccacaacatcctggtggaggtccaggacgacgggaccatgaagatcaaggacgaggagcgggacgacaccctcaccatcctgctgaaggcctccctcctggccgtgagcggcgtgtacccgatgtccatccccgcgaccctgttcgtctggtacttctggcagaagaagaagcagcgcagcggggtgctctgggacacgcccagcccgcccgaggtggagcgggccgtcctggacgacggcatctaccgcatcctgcagcggggcctgctcgggcgcagccaggtgggcgtggggatcttccaggacggcgtcttccacaccatgtggcacgtgacccgcggggccgtgctgatgtaccagggcaagcgcctggagccctcctgggccagcgtcaagaaggacctcatctcctacggcgggggctggcggttccaggggagctggaacaccggcgaggaggtccaggtgatcgccgtcgagcccgggaagaaccccaagaacgtgcagacgacccccggcatcttcaagacccccgagggcgaggtgggggcgatcaccctggacttcaagcccggcacgtccgggagccccatcgtcaaccgcgagggcaagatcgtgggcctgtacgggaacggcgtggtcaccaccagcgggacctacgtgtccgccatcgcccaggccaaggccagccaggagggcccgctccccgagatcgaggacgaggtgttccggaagcgcaacctgacgatcatggacctgcaccccgggtccggcaagacccggcgctacctcccggcgatcgtccgggaggccatgaagcgcaagctgcggaccctgatcctcgcccccacccgcgtggtggccagcgagatggcggaggccctgaagggcatgcccatccgctaccagacgaccgccgtcaagtccgagcacaccgggcgggagatcgtggacctgatgtgccacgccaccttcacgatgcgcctcctgagccccgtgcgggtcccgaactacaacatgatcatcatggacgaggcccacttcaccgaccccgcgtccatcgccgcccgcggctacatcagcacccgggtggggatgggcgaggccgccgcgatcttcatgaccgccacgccgcccgggtccgtggaggccttcccgcagagcaacgccgtcatccaggacgaggagcgcgacatccccgagcggtcctggaacagcggctacgactggatcaccgacttccccggcaagaccgtgtggttcgtgccctccatcaagagcgggaacgacatcgccaactgcctgcgcaagaacggcaagcgggtcatccagctctcccgcaagaccttcgacacggagtaccagaagaccaagaacaacgactgggactacgtggtgaccaccgacatcagcgagatgggggcgaacttccgggccgaccgcgtcatcgacccgcggcgctgcctgaagcccgtgatcctgaaggagggccccgagcgggtcatcctcgccgggcccatgccggtgacggtggcctccgcggcccagcgccggggccgcatcggccggaaccagaacaaggagggggaccagtacgtctacatgggccagcccctgaacaacgacgaggaccacgcccactggaccgaggccaagatgctgctcgaccacatcaacacccccgaggggatcatccccgccctgttcgagccggagcgcgagaagtccgcggccatcgacggcgagtaccgcctgcgcggggaggcccgcaagaccttcgtggagctcatgcggcgcggcgacctgcccgtgtggctgtcctacaaggtcgccagcgagggcttccagtacacggaccggcgctggtgcttcgacggggagcggaacaaccaggtgctcgaggagaacatggacgtggagatctggatggaggagggcgagaagaagaagatccgcccccggtggctggagatcgagaagtacagcgaccccctggccctccgcgagttcaaggagttctccgcgaagcgcaagagcgtcctgggggacctgaagctcgagatcggcaagctgccgcagcacctgaccatcaaggcccgcaacgccctcgacaacctggtgatgctgcacaactccgagcagggcgggaaggcctaccggcacgccatggaggagctccccgacaccatcgagaccctgatgcgcctgggcctcatcgcggtgatgaccggcggggtcaccctgttcttcctgagcgggaaggggctcggcaagacctccaacgggctgctgtgcgtgatggccagctccgtgctcctgtggatggccagcgtcgagccccactggatcgccgcgtccatcatcctggagttcttcctcatggtgctgctgatccccgagccggaccggcagcgcacgccccaggacaaccagctcgcctacgtggtcatcggcctgctgttcatgatcctcaccgtggccgccaacgagatggggctgctggagacgaccaagaaggacctcggcatcgggcacgtggtcgccgagaaccaccaccacgcgaccatgctggacgtggacctgcaccccgccagcgcctggaccctctacgccgtggccacgaccatcatcaccccgatgatgcggcacaccatcgagaacacgaccgcgaacatctccctgaccgccatcgccaaccaggccgccatcctgatgggcctcgacaagggctggcccatcagcaagatggacatcggggtccccctgctggcgctcggctgctactcccaggtgaaccccctgaccctgacggccgccgtgctcatgctggtcgcccactacgccatcatcgggccgggcctgcaggcgaaggccacccgcgaggcccagaagcggaccgcgccccagatcatgaagaaccagatcgtggacgggatcgtggcggtcgacctcgaccccgtggtgtacgacgccaagttcgagaagcagctgggccagatcatgctgctcatcctgtgcaccagccagatcctgctcatgcgcacgacctgggccctgtgcgagtccatcaccctggccaccggccccctcacgaccctgtgggaggggagcccgggcaagttctggaacaccaccatcgccgtctccatggcgaacatcttccgggggagctacctggccggcgccggcctcgccttctccctgatgaagtccctcgggggcgggcgccgcgggacgggggcccagggcgagaccctcggcgagaagtggaagcggcagctgaaccagctgagcaagtccgagttcaacacctacaagcgcagcgggatcatggaggtggaccggtccgaggcgaaggagggcctcaagcgcggggagaccacgaagcacgccgtgagccggggcaccgccaagctgcgctggttcgtcgagcggaacctggtgaagcccgaggggaaggtgatcgacctcggctgcggccgcgggggctggtcctactactgcgccgggctgaagaaggtcaccgaggtgaagggctacaccaagggcgggcccggccacgaggagcccatcccgatggccacgtacgggtggaacctggtgaagctgcacagcggcaaggacgtcttcttcacgccgcccgagaagtgcgacaccctcctgtgcgacatcggggagtccagccccaacccgaccatcgaggagggccggacgctgcgcgtgctcaagatggtggagccctggctgcgggggaaccagttctgcatcaagatcctgaacccctacatgccctccgtcgtggagaccctcgagcagatgcagcgcaagcacggcggcatgctggtgcggaacccgctgagccgcaactccacccacgagatgtactgggtcagctgcgggaccggcaacatcgtgtccgcggtgaacatgaccagccggatgctcctgaaccgcttcacgatggcccaccggaagcccacctacgagcgcgacgtcgacctgggggccggcacccggcacgtggccgtcgagcccgaggtggcgaacctcgacatcatcggccagcgcatcgagaacatcaagaacgagcacaagtccacctggcactacgacgaggacaacccctacaagacgtgggcctaccacgggagctacgaggtgaagccgtccggcagcgcctccagcatggtcaacggggtggtgcgcctgctgaccaagccctgggacgtcatccccaccgtgacccagatcgccatgacggacaccacccccttcggccagcagcgggtgttcaaggagaaggtcgacacccgcacgccgaaggccaagcgggggaccgcgcagatcatggaggtgaccgccaactggctctggggcttcctgagccgcaacaagaagccccggatctgcacccgcgaggagttcacgcggaaggtgcgctccaacgccgccatcggcgccgtcttcgtggacgagaaccagtggaacagcgcgaaggaggccgtggaggacgagcggttctgggacctggtccaccgcgagcgggagctccacaagcaggggaagtgcgcgacctgcgtgtacaacatgatgggcaagcgcgagaagaagctgggggagttcggcaaggccaaggggtcccgggccatctggtacatgtggctgggcgcgcgcttcctcgagttcgaggccctgggcttcatgaacgaggaccactggttcagccgggagaactccctgagcggggtggagggcgaggggctccacaagctgggctacatcctgcgcgacatctccaagatccccgggggcaacatgtacgccgacgacaccgccggctgggacacccggatcacggaggacgacctccagaacgaggcgaagatcaccgacatcatggagccggagcacgccctgctggccaccagcatcttcaagctcacctaccagaacaaggtcgtgcgcgtgcagcggcccgccaagtccgggacggtcatggacgtgatcagccgccgggaccagcgcggctccggccaggtgggcacctacggcctgaacaccttcaccaacatggaggtccagctgatccgccagatggagagcgaggggatcttcctcccctccgagctggagacgcccaacctggccgagcgggtgctcaactggctggagaagcacggcgtggagcgcctgaagcggatggcgatcagcggggacgactgcgtcgtgaagccgaccgacgaccgcttcgccaccgccctcaccgccctgaacgacatgggcaaggtgcggaaggacacgccccagtgggagccctccaaggggtggaacgactggcagcaggtccccttctgcagccaccacttccaccagctgatcatgaaggacggccgcgagatcgtggtgccgtgccggaaccaggacgagctcgtcggccgcgcccgggtgtcccacggggcgggctggagcctgcgcgagaccgcctgcctgggcaagagctacgcccagatgtggcagctcatgtacttccaccggcgcgacctgcggctggccgccaacgcgatctgctccgccgtgcccgtcgactgggtgcccaccagccgcaccacgtggtccatccacgcccaccaccagtggatgaccaccgaggacatgctcagcgtgtggaaccgggtctggatcgaggagaacccctggatggaggacaagacccacgtgtccagctgggaggacgtgccgtacctgggcaagcgcgaggaccagtggtgcgggtccatcatcggcctgaccgcccgggccacgtgggcgaccaacatccaggtcgccatcaaccaggtgcgccggctcatcggcaacgagaactacctggactacatgaccagcatgaagcgcttcaagaacgagtccgaccccgagggggccctgtggtga

SEQ ID NO: 7987 - RNA, 9879 nt, synthetic construct
  misc_feature 1..9879: note = derived and/or modified CDS sequence (opt1) from DENV-1__JQ922545__SS-prME
  source 1..9879: mol_type = other RNA
agcgtgaccatgctgctcatgctgctgcccaccgccctcgccttccacctgaccacccggggcggggagccccacatgatcgtgagcaagcaggagcggggcaagagcctgctgttcaagaccagcgcgggggtgaacatgtgcaccctgatcgccatggacctgggcgagctctgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctggcgccccacgtgggcctggggctcgagacgcgcaccgagacctggatgagcagcgagggcgcctggcggcagatccagaaggtcgagacctgggccctgcgccaccccgggttcacggtgatcgccctgttcctcgcgcacaccatcggcaccagcatcacccagaaggggatcatcttcatcctgctgatgacgggcgcccccatcatggccatgcggtgcgtgggcatcgggaaccgcgacttcgtcgagggcctcagcggggccccctgggtggacgtggtcctggagcacggcagctgcctgtccaacatggccaagaacaagcccaccctcgacatcgacttcttcaagaccgaggtgaccaacccggcggtgctgcggaagctgtgcatcgaggccaagatcagcaacacgaccaccgactcccgctgccccacccagggcgaggccacgctcgtcgaggagcaggacgccaacttcgtgtgccggcgcaccttcgtggaccgggggtggggcaacgggtgcggcctgttcgggaagggcagcctgctgacctgcgccaagttcaagtgcgtcaccaagctggagggcaagatcgtgcagtacgagaacctgaagtactccgtgatcgtcacggtgcacaccggggaccagcaccaggtgggcaacgagaccaccgagcacgggacgatcgcgaccatcacgccccaggcccccaccagcgagatccagctcaccgactacggcgccctgacgctggactgctccccgcgcaccgggctcgacttcaacgagatggtcctgctgaccatgaaggagaagtcctggctcgtgcacaagcagtggttcctggacctgcccctcccctggacctccggcgccagcacgagccaggagacctggaaccggcaggacctgctggtcaccttcaagaccgcccacgcgaagaagcaggaggtggtggtcctcggctcccaggagggggccatgcacacggccctgaccggcgccaccgagatccagatgagcgggaccacgaccatcttcgccggccacctgaagtgccgcctcaagatggacaagctgaccctgaagggggtgtcctacgtgatgtgcaccggcagcttcaagctcgagaaggaggtcgcggagacgcagcacggcaccgtgctggtgcaggtcaagtacgaggggaccgacgccccctgcaagatcccgttctccacccaggacgagaagggcgtgacgcagaacgggcggctgatcaccgccaaccccatcgtgaccgacaaggagaagcccgtcaacatcgagaccgagcccccgttcggcgagagctacatcgtgatcggcgccggggagaaggcgctgaagctctcctggttcaagaagggcagctccatcgggaagatgttcgaggccacggcccgcggcgcccggcgcatggccatcctgggggacaccgcgtgggacttcggcagcatcggcggggtgttcacctccgtcggcaagctggtgcaccaggtgttcgggaccgcctacggcgtcctcttcagcggggtgtcctggacgatgaagatcggcatcggcatcctgctgacctggctcgggctgaacagccgctccaccagcctgtccatgacctgcatcgccgtgggcatggtcacgctctacctgggggtgatggtgcaggccgacagcggctgcgtcatcaactggaaggggcgggagctgaagtgcggctccggcatcttcgtgaccaacgaggtgcacacctggaccgagcagtacaagttccaggccgacagccccaagcgcctcagcgcggccatcgggaaggcctgggaggagggcgtctgcgggatccggtccgccacgtgcctggagaacatcatgtggaagcagatcagcaacgagctgaaccacatcctcctggagaacgacatgaagttcaccgtggtggtcggcgacgccaacgggatcctgacccagggcaagaagatgatccgcccccagcccatggagcacaagtactcctggaagtcctggggcaaggcgaagatcatcggggccgacatccagaacaccaccttcatcatcgacggcccggacacgcccgagtgccccgacgaccagcgggcctggaacatctgggaggtggaggactacgggttcggcatcttcaccaccaacatctggctcaagctgcgcgactcctacacccagatgtgcgaccaccggctgatgagcgccgcgatcaaggactccaaggccgtgcacgccgacatgggctactggatcgagagcgagaagaacgagacgtggaagctcgcccgcgcctccttcatcgaggtcaagacctgcatctggccccggagccacaccctgtggtccaacggggtgctggagagcgagatgatcatcccgaagatctacggcgggcccatctcccagcacaactaccgccccggctacttcacccagacggcggggccgtggcacctcggcaagctggagctggacttcgacctctgcgagggcaccaccgtggtcgtggacgagcactgcgggaaccggggccccagcctgcgcaccacgaccgtgaccgggaagatcatccacgagtggtgctgccggtcctgcaccctgccgcccctccgcttcaagggcgaggacgggtgctggtacggcatggagatccggccggtcaaggagaaggaggagaacctggtgcgcagcatggtgtccgccggcagcggggaggtcgacagcttctccctgggcctcctgtgcgtgagcatcatgatcgaggaggtgatgcggtcccgctggagccggaagatgctgatgacggggaccctcgccgtcttcttcctgctgatcatgggccagctcacctggaacgacctgatccgcctgtgcatcatggtgggggccaacgtgtccgaccgcatgggcatgggcaccacgtacctcgccctgatggcgaccttcaagatgcggcccatgttcgccgtcgggctcctcttccgccggctgaccagccgcgaggtgctgctcctgaccatcgggctgtccctcgtggccagcgtcgagctgcccaactccctggaggagctcggggacggcctggccatgggcatcatgatgctgaagctcctgacggacttccagagccaccagctgtggaccaccctcctgtccctgaccttcatcaagacgaccctcagcctggactacgcctggaagaccatcgcgatggtgctgtccatcgtcagcctcttccccctgtgcctgtccaccacgagccagaagaccacctggctcccggtgctgctggggtccttcggctgcaagcccctcaccatgttcctgatcacggagaacaagatctgggggcgcaagagctggcccctgaacgagggcatcatggccgtggggatcgtctccatcctcctgagcagcctgctcaagaacgacgtgcccctggccggcccgctgatcgccggcgggatgctcatcgcgtgctacgtgatctccggcagctccgccgacctgagcctggagaaggccgccgaggtctcctgggaggaggaggcccagcacagcggggcgtcccacaacatcctcgtggaggtgcaggacgacggcaccatgaagatcaaggacgaggagcgcgacgacaccctgaccatcctgctcaaggccaccctgctggccgtcagcggggtgtaccccatgtccatccccgccaccctcttcgtgtggtacttctggcagaagaagaagcagcggagcggcgtcctgtgggacaccccctccccgcccgaggtggagcgcgccgtgctggacgacggcatctaccggatcctccagcgcgggctgctgggccggagccaggtcggggtgggcgtgttccaggacggggtcttccacaccatgtggcacgtgacccgcggcgcggtgctgatgtaccagggcaagcggctcgagccctcctgggccagcgtcaagaaggacctgatctcctacgggggcgggtggcgcttccagggcagctggaacacgggggaggaggtccaggtgatcgccgtcgagcccggcaagaacccgaagaacgtgcagaccacccccggcaccttcaagacgcccgagggggaggtgggcgccatcgccctggacttcaagcccgggacctccggcagcccgatcgtcaaccgggagggcaagatcgtggggctctacggcaacggggtggtcaccacctccggcacgtacgtgagcgcgatcgcccaggccaaggccagccaggaggggcccctgcccgagatcgaggacgaggtgttcaagaagcgcaacctgaccatcatggacctccacccgggctccggcaagacccggcgctacctgcccgccatcgtccgggaggcgatcaagcgcaagctgcggaccctcatcctggcccccacgcgcgtggtggccagcgagatggccgaggcgctgaaggggatgcccatccgctaccagaccaccgccgtcaagtccgagcacaccggccgggagatcgtggacctcatgtgccacgccacgttcaccatgcgcctgctgagcccggtgcgggtccccaactacaacatgatcatcatggacgaggcccacttcaccgaccccgcctccatcgcggcccgcgggtacatcagcacccgggtgggcatgggggaggccgccgccatcttcatgacggcgacgcccccgggctccgtggaggccttcccccagagcaacgccgtcatccaggacgaggagcgcgacatccccgagcggtcctggaacagcggctacgactggatcaccgacttccccgggaagaccgtgtggttcgtgccgtccatcaagagcggctccgacatcgccacggtcctcgagcgcagccgggagcccgtgatccagctgtcccgcaagaccttcgacaccgagtaccagaagaccaagaacaacgactgggactacgtggtcacgaccgacatcagcgagatgggggccaacttccgggcggaccgcgtgatcgacccccggcgctgcctgaagcccgtgatcccgaaggacggccccgagcgggtcatcctcgccgggcccatgcccgtgaccgtcgcctccgccgcgcagcgccggggccgcatcggccggaaccagaacaaggagggggaccagtacatctacatgggccagccgctgaacaacgacgaggaccacgcccactggaccgaggccaagatgctgctcgacaacatcaacacgcccgaggggatcatccccgccctgttcgagcccgagcgcgagaagtccgccgcgatcgacggcgagtaccgcctgcgcggggaggcccgcaagaccttcgtggagctcatgcggcgcggcgacctgccggtgtggctgtcctacaaggtcgccagcgagggcttccagtacagcgaccggcgctggtgcttcgacggggagcggaacaaccaggtgctcgaggagaacatggacgtggagatctggaccaaggagggcgagcgcaagaagctgcggccccgctggctggacgcccggacctactccgaccccctcgccctgcgcgagttcaaggagttcgcggccgggcggcgcagcgtctccggcgacctgatcctcgagatcgagaagctgccccagcacctgacgctccgggcccagaacgccctggacaacctggtgatgctccacaacagcgagcagggcgggaaggcctaccgccacgcgatggaggagctgccggacaccatcgagaccctgatgctcctggccctgatcgccgtgctcaccggcggggtcaccctgttcttcctgtccggcaaggggctcggcaagacgagcatcggcctgctgtgcgtgatggcctccagcgtgctcctgtggatggcgtccgtcgagccccactggatcgccgccagcatcatcctggagttcatcctcatggtgctgctgatccccgagccggaccggcagcgcacgccccaggacaaccagctcgcctacgtggtcatcgggctgctgttcatgatcctcaccgtggccgcgaacgagatgggcctgctggagaccacgaagaaggacctcgggatcggccacgtggtcgccgagaaccaccaccacgccaccatgctggacatcgacctgcaccccgcctccgcctggaccctctacgcggtggccaccacgatcatcacccccatgatgcggcacaccatcgagaacaccacggccaacatcagcctgaccgccatcgccaaccaggcggccatcctgatggggctcgacaagggctggccgatctccaagatggacatcggcgtgcccctgctggccctcgggtgctacagccaggtcaaccccctgaccctgaccgccgccgtgctcatgctggtggcgcactacgccatcatcggccccgggctgcaggccaaggccacgcgcgaggcgcagaagcggaccgccgccggcatcatgaagaacccgaccgtcgacgggatcgtggccatcgacctcgaccccgtggtctacgacgccaagttcgagaagcagctgggccagatcatgctgctcatcctgtgcacctcccagatcctgctcatgcgcacgacctgggcgctgtgcgagagcatcaccctggccaccggccccctcacgaccctgtgggaggggtcccccggcaagttctggaacaccaccatcgccgtgagcatggccaacatcttccgcgggtcctacctggccggcgcgggcctcgccttcagcctgatgaagtccctcgggggcgggcggcgcgggacgggggcccagggcgagaccctcggcgagaagtggaagcggcagctgaaccagctgtccaagagcgagttcaacacctacaagcgctccgggatcatggaggtggaccggagcgaggccaaggagggcctcaagcgcggggagaccacgaagcacgccgtctcccggggcaccgcgaagctgcgctggttcgtggagcggaacctggtgaagccggaggggaaggtcatcgacctcggctgcggccgcgggggctggagctactactgcgccgggctgaagaaggtgaccgaggtgaagggctacaccaagggcgggcccggccacgaggagcccatccccatggccacgtacgggtggaacctggtcaagctgcactccggcaaggacgtgttcttcaccccgcccgagaagtgcgacaccctcctgtgcgacatcggggagagctcccccaaccccaccatcgaggagggccggaccctgcgcgtgctcaagatggtcgagccgtggctgcgggggaaccagttctgcatcaagatcctgaacccctacatgcccagcgtggtggagacgctcgagcagatgcagcgcaagcacggcggcatgctggtccggaaccccctgtcccgcaacagcacccacgagatgtactgggtgtcctgcgggaccggcaacatcgtgagcgccgtcaacatgacctcccggatgctcctgaaccgcttcacgatggcgcaccggaagccgacctacgagcgcgacgtggacctgggggccggcacccgccacgtggccgtcgagcccgagatcgccaacctcgacatcatcggccagcggatcgagaacatcaagatcgggcacaagagcacctggcactacgacgaggacaacccctacaagacgtgggcctaccacggctcctacgaggtgaagcccagcgggtccgcgagcagcatggtgaacggcgtcgtgcgcctgctgaccaagccgtgggacgtcatccccatggtgacccagatcgccatgaccgacacgacccccttcgggcagcagcgggtgttcaaggagaaggtcgacacccgcaccccgcggcccaagcgcggcacggcccagatcatggaggtgaccgccaagtggatgtggggcttcctcttccggaaccggccgccccggatctgcacccgcgacgagttcgcccggaaggtgcgctccagcaccgcgaacggggccgtcttcgtggacgagaaccagtggaactccgccaaggaggccgtggaggacgagcggttctgggacctggtccaccgcgagcgggagctgcacaagcagggcaagtgcgccacgtgcgtgtacaacatgatggggaagcgcgagaagaagctcggcgagttcgggaaggcgaagggcagccgggccatctggtacatgtggctgggcgcccgcttcctggagttcgaggccctcgggttcatgaacgaggaccactggttctcccgggagaacagcctgtccggcgtggagggggagggcctgcacaagctcgggtacatcctgcgcgacatcagcaagatcccgggcggcaacatgtacgcggacgacaccgccgggtgggacacccggatcaccgaggacgactccagcaacgaggccaagatcatcgagctgatgcgccccgagcacgccctcctggccacgtccatcttcaagctgaccttccagatcagcgtcgtgcgcgtgcagcggcccgcgaagtccggcaccgtcatggagtgcatcagccgccgggaccagaagcgctccggccaggtgggcacctacggcctcaacacgttcaccaacatggaggtgcagctgatccggcagatggagagcgaggggatcttctcccccagcgagatggagaacagcaacctggccgagcgcgtcctcgactggctggagaagcacggcgtggagcggctgaagcgcatggccatctccggggacgactgcgtggtcaagccgaccgacgaccggttcgccaccgccctcacggcgctgaacgacatgggcaaggtgcgcaaggacatcccccagtgggagcccagcaaggggtggaacgactggcagcaggtccccttctgctcccaccacttccaccagctgatcatgaaggacggccgggagatcgtcgtgccgtgccgcaaccaggacgagctcgtgggccgggcccgcgtcagccagggggccggctggtccctgcgggagaccgcctgcctgggcaagagctacgcccagatgtggcagctcatgtacttccaccgccgggacctgcgcctggcggccaacgccatctgctccgccgtgcccgtggactgggtccccaccagccggaccacgtggtccatccacgcccaccaccagtggatgaccaccgaggacatgctcagcgtgtggaaccgcgtgtggatcgaggagaacccctggatggaggacaagacccacgtctccagctgggaggacgtgccgtacctgggcaagcgcgaggaccagtggtgcgggtccctgatcggcctcaccgcgcgggccacgtgggccaccaacatccaggtggccatcaaccaggtccgccggctgatcggcaacgagaactacctggactacatgaccagcatgaagcgcttcaagaacgagtccgaccccgagggggcgctctggtga

SEQ ID NO: 7988 - RNA, 9879 nt, synthetic construct
  misc_feature 1..9879: note = derived and/or modified CDS sequence (opt1) from DENV-1__GU131887__SS-prME
  source 1..9879: mol_type = other RNA
agcgtgaccatgctgctcatgctgatgcccaccgccctggccttccacctcaccacccgcggcggggagccccacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacgtgggtgacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccaccccgggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcgatcctgcggaagctctgcatcgaggccaagatctccaacaccaccacggacagccgctgccccacccagggcgaggccaccctggtggaggagcaggacgccaacttcgtgtgccggcgcaccttcgtcgaccggggctgggggaacggctgcgggctgttcggcaaggggtccctcatcacgtgcgccaagttcaagtgcgtgaccaagctggagggcaagatcgtgcagtacgagaacctgaagtacagcgtcatcgtgaccgtgcacaccggcgaccagcaccaggtcgggaacgagtccacggagcacggcaccaccgcgaccatcacgccccaggcccccacgaccgagatccagctcaccgactacggggccctgaccctggactgcagcccccgcacgggcctcgacttcaacgagatggtgctgctgaccatgaaggagaagtcctggctcgtccacaagcagtggttcctggacctgccgctcccctggaccagcggggccagcacctcccaggagacgtggaaccggcaggacctgctggtgaccttcaagaccgcccacgcgaagaagcaggaggtggtcgtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtgatgtgcaccgggtccttcaagctcgagaaggaggtcgcggagacgcagcacggcaccgtgctggtgcagatccggtacgagggcaccgacgccccctgcaagatccccttcagcacccaggacgagcgcggggtcacgcagaacggccggctgatcaccgccaacccgatcgtgaccgacaaggagaagcccgtgaacatcgaggccgagccgcccttcggggagtcctacatcgtcatcggcgcgggcgagaaggccctgaagctcagctggttcaagaaggggtccagcatcggcaagatgttcgaggccaccgcccgcggggcccgccggatggcgatcctgggcgacacggcctgggacttcgggtccatcggcggcgtgttcaccagcgtggggaagctggtccaccagatcttcggcaccgcctacggggtcctcttctccggcgtgagctggaccatgaagatcgggatcggcgtcctgctgacgtggctcggcctgaactcccgcagcacctccttcagcatgacctgcatcgccgtggggctggtgaccctctacctgggcgtcatggtgcaggccgactccgggtgcgtgatcaactggaagggccgggagctgaagtgcgggagcggcatcttcgtcacgaacgaggtgcacacctggaccgagcagtacaagttccaggcggacagcccgaagcgcctctccgccgccatcggcaaggcctgggaggagggggtgtgcggcatccggagcgccacccgcctggagaacatcatgtggaagcagatctccaacgagctgaaccacatcctcctggagaacgacatgaagttcaccgtcgtggtgggggacgtcgcgggcatcctggcccaggggaagaagatgatccggccccagcccatggagtacaagtacagctggcgctcctggggcaaggccaagatcatcggcgccgacgtgcagaacacgaccttcatcatcgacgggcccaacaccccggagtgccccgacgaccagcgggcgtggaacatctgggaggtggaggactacggcttcgggatcttcaccacgaacatctggctcaagctgcgcgacagctacacccaggtctgcgaccaccggctgatgtccgccgccatcaaggacagcaaggccgtgcacgccgacatgggctactggatcgagtccgagaagaacgagacctggaagctcgcgcgcgccagcttcatcgaggtgaagacctgcatctggcccaagtcccacacgctgtggagcaacggcgtcctggagtccgagatgatcatccccaagatctacgggggcccgatcagccagcacaactaccggcccgggtacttcacccagaccgccggcccctggcacctcgggaagctggagctggacttcgacctctgcgagggcaccacggtggtggtcgacgagcactgcggcaaccgcgggccgtccctgcggaccaccaccgtgacgggcaagatcatccacgagtggtgctgccgcagctgcaccctgccgcccctccggttccgcggggaggacggctgctggtacgggatggagatccggcccgtgaaggagaaggaggagaacctggtcaagtccatggtgagcgccggcagcggcgaggtggactccttcagcctggggctcctgtgcatctccatcatgatcgaggaggtcatgcgcagccgctggtcccggaagatgctgatgaccggcaccctcgccgtgttcctgctgctcatcatggggcagctgacgtggaacgacctgatccgcctctgcatcatggtgggcgcgaacgccagcgaccggatggggatgggcaccacctacctggccctgatggccaccttcaagatgcgcccgatgttcgccgtcgggctcctgttccggcgcctgacgtcccgggaggtgctcctgctgaccatcgggctcagcctggtggcgtccgtcgagctgcccaacagcctcgaggagctgggcgacgggctggccatgggcatcatgatcctcaagctgctgaccgacttccagtcccaccagctctgggccaccctgctgagcctcacgttcatcaagaccaccttctccctgcactacgcctggaagaccatggcgatggtgctgagcatcgtctccctcttccccctgtgcctgagcacgacctcccagaagaccacctggctccccgtgctgctgggcagcctcgggtgcaagccgctgacgatgttcctgatcgccgagaacaagatctggggccgccggtcctggcccctcaacgaggggatcatggccgtgggcatcgtcagcatcctgctgagctccctcctgaagaacgacgtgcccctggccgggcccctcatcgccggcggcatgctgatcgcgtgctacgtgatcagcgggtccagcgccgacctgtccctcgagaaggccgccgaggtcagctgggaggaggaggccgagcactccggcgcgagccacaacatcctggtggaggtgcaggacgacgggaccatgaagatcaaggacgaggagcgcgacgacaccctgaccatcctcctgaaggccaccctgctcgccgtctccggcgtgtacccgctgagcatccccgccacgctgttcgtgtggtacttctggcagaagaagaagcagcggtccggggtcctctgggacacccccagcccgcccgaggtggagcgcgccgtgctggacgacggcatctaccggatcatgcagcgcggcctgctggggcggtcccaggtcggcgtgggggtgttccaggagaacgtcttccacaccatgtggcacgtgacccgcggcgcggtgctcatgtaccaggggaagcggctggagcccagctgggcctccgtcaagaaggacctgatcagctacggcggcgggtggcgcctccagggctcctggaacacgggggaggaggtccaggtgatcgccgtcgagcccggcaagaaccccaagaacgtgcagaccgcccccgggaccttcaagacccccgagggcgaggtgggcgccatcgcgctggacttcaagcccgggacgagcggctcccccatcgtcaaccgggaggggaagatcgtgggcctgtacggcaacggggtggtcaccaccagcggcacctacgtgagcgccatcgcccaggccaaggcgtcccaggaggggccgctccccgagatcgaggacgaggtgttccgcaagcggaacctgacgatcatggacctgcaccccggcagcgggaagacccgccgctacctcccggccatcgtccgggaggccatcaagcgcaagctgcggaccctgatcctcgcccccacccgcgtggtggcctccgagatggcggaggccctgaagggcatgcccatccggtaccagacgaccgccgtcaagagcgagcacaccggcaaggagatcgtggacctgatgtgccacgccaccttcacgatgcgcctcctgtcccccgtgcgggtcccgaactacaacatgatcatcatggacgaggcccacttcaccgaccccagctccatcgcggcccgcgggtacatcagcacccgggtgggcatgggggaggccgccgccatcttcatgaccgcgacgccgcccggctccgtggaggccttcccgcagagcaacgccgtcatccaggacgaggagcgcgacatccccgagcggtcctggaacagcgggtacgagtggatcaccgacttccccggcaagaccgtgtggttcgtgccctccatcaagagcggcaacgacatcgccaactgcctgcgcaagaacgggaagcgggtcatccagctctcccgcaagaccttcgacacggagtaccagaagaccaagaacaacgactgggactacgtggtgaccaccgacatcagcgagatgggcgcgaacttccgggccgaccgcgtcatcgacccgcggcgctgcctgaagcccgtgatcctgaaggacgggcccgagcgggtgatcctcgccggccccatgccggtcacggtggcctccgccgcgcagcgccgcgggcggatcggccgcaaccacaacaaggagggcgaccagtacatctacatggggcagcccctgaacaacgacgaggaccacgcccactggaccgaggccaagatgctgctcgacaacatcaacacccccgagggcatcatccccgccctgttcgagccggagcgggagaagtccgccgcgatcgacggggagtaccgcctgcggggcgaggcccgcaagaccttcgtcgagctcatgcggcgcggggacctgcccgtgtggctgtcctacaaggtggccagcgagggcttccagtacagcgaccggcgctggtgcttcgacggcgagcggaacaaccaggtcctcgaggagaacatggacgtggagatctggacgaaggagggggagcgcaagaagctgcggccccgctggctggacgcccggacctactccgaccccctcgccctgcgcgagttcaaggagttcgcggccggccggcgcagcgtgtccggggacctgatcctcgagatcggcaagctgccgcagcacctgacccagcgggcccagaacgccctcgacaacctggtcatgctgcacaacagcgagcagggcgggcgcgcgtaccggcacgccatggaggagctccccgacaccatcgagacgctgatgctgctcgccctgatcgccgccctgaccggcggggtgaccctcttcttcctgtccggccgcgggctgggcaagaccagcatcggcctcctgtgcgtgatggcgtccagcgtcctgctctggatggcctccgtggagccccactggatcgccgccagcatcatcctggagttcttcctgatggtgctcctgatccccgagccggaccgccagcggacgccccaggacaaccagctggcctacgtcgtgatcgggctcctgttcatgatcctgacggtggcggccaacgagatgggcctcctggagaccaccaagaaggacctggggatcggccacgtcgccgtggggaaccaccaccacgccgccatgctcgacgtggacctgcaccccgcgtccgcctggaccctgtacgccgtcgccacgaccatcatcaccccgatgatgcgccacaccatcgagaacacgaccgccaacatcagcctcaccgcgatcgccaaccaggccgccatcctgatgggcctggacaagggctggcccatctccaagatggacatcggggtgcccctcctggcgctgggctgctacagccaggtgaaccccctcaccctgacggccgccgtcctgatgctcgtggcccactacgccatcatcgggccgggcctgcaggcgaaggccacccgggaggcccagaagcgcaccgccgccgggatcatgaagaaccccaccgtggacggcatcgtcgcgatcgacctggaccccgtggtgtacgacgccaagttcgagaagcagctcggccagatcatgctgctgatcctctgcacgtcccagatcctgctgatgcggaccacctgggccctctgcgagagcatcaccctggccacggggcccctgaccaccctctgggagggctccccggggaagttctggaacaccacgatcgccgtcagcatggcgaacatcttccgcggctcctacctggccggcgccgggctggccttcagcctcatgaagtccctgggcgggggccggcgcgggaccggcgcgcagggcgagaccctgggggagaagtggaagcggcagctcaaccagctgtccaagagcgagttcaacacctacaagcgctccggcatcatggaggtggaccggagcgaggccaaggaggggctgaagcgcggcgagatcacgaagcacgccgtgtcccgggggaccgccaagctccgctggttcgtcgagcggaacctggtgaagcccgagggcaaggtgatcgacctgggctgcgggcgcggcgggtggagctactactgcgccggcctgaagaaggtcaccgaggtgaaggggtacaccaagggcggccccgggcacgaggagcccatcccgatggcgacgtacggctggaacctcgtgaagctgcactccgggaaggacgtcttcttcgtgccgcccgagaagtgcgacaccctgctctgcgacatcggcgagagctcccccaacccgaccatcgaggaggggcggaccctgcgcgtgctgaagatggtcgagccctggctccggggcaaccagttctgcatcaagatcctgaacccctacatgcccagcgtggtggagacgctggagcagatgcagcgcaagcacggcgggatgctcgtccgcaacccgctgtcccggaacagcacccacgagatgtactgggtgtcctgcggcaccgggaacatcgtgagcgccgtcaacatgacctcccgcatgctgctcaaccggttcaccatggcccaccgcaagcccacgtacgagcgggacgtggacctgggcgccggcacccgccacgtggccgtcgagcccgaggtggcgaacctggacatcatcgggcagcggatcgagaacatcaagcacgagcacaagagcacctggcactacgacgaggacaacccctacaagacctgggcctaccacggctcctacgaggtgaagccgagcgggtccgccagcagcatggtcaacggcgtggtcaagctcctgacgaagccctgggacgtgatccccatggtgacccagatcgccatgaccgacaccacgcccttcgggcagcagcgcgtcttcaaggagaaggtggacacccggaccccgaaggccaagcgcggcaccgcgcagatcatggaggtgacggccaagtggctgtggggcttcctctcccggaacaagaagccccgcatctgcacccgggaggagttcacccgcaaggtccggagcaacgccgccatcggggcggtgttcgtggacgagaaccagtggaactccgccaaggaggccgtcgaggacgagcgcttctgggacctggtgcaccgggagcgcgagctgcacaagcagggcaagtgcgcgacctgcgtgtacaacatgatggggaagcgggagaagaagctcggcgagttcgggaaggccaagggcagccgcgcgatctggtacatgtggctgggcgcccggttcctggagttcgaggccctcgggttcatgaacgaggaccactggttctcccgcgagaacagcctgtccggcgtcgagggggagggcctgcacaagctcgggtacatcctgcgcgacatcagcaagatccccggcggcaacatgtacgccgacgacacggccgggtgggacacccggatcaccgaggacgacctgcagaacgaggcgcgcatcaccgacatcatggagccggagcacgccctcctggccaagtccatcttcaagctgacgtaccagaacaaggtggtgcgggtccagcgccccgccaagaacggcaccgtgatggacgtgatcagccggcgcgaccagcgggggtccggccaggtcggcacctacgggctcaacaccttcacgaacatggaggcccagctgatccgccagatggagagcgagggcatcttctcccccagcgagctggagacccccaacctcgcggagcgggtgctggactggctggagaagtacggggtggagcgcctcaagcggatggccatctccggcgacgactgcgtcgtgaagccgatcgacgaccgcttcgccaccgccctgaccgccctgaacgacatggggaaggtgcggaaggacatcccccagtgggagcccagcaagggctggaacgactggcagcaggtccccttctgctcccaccacttccaccagctcatcatgaaggacggccgcgagatcgtggtgccgtgccggaaccaggacgagctggtcgggcgcgcgcgggtgagccagggcgccgggtggagcctgcgcgagacggcctgcctcggcaagtcctacgcccagatgtggcagctgatgtacttccaccggcgcgacctgcgcctcgcggccaacgccatctgcagcgccgtgcccgtcgactggatccccacctcccggaccacctggagcatccacgcccaccaccagtggatgacgaccgaggacatgctgtccgtgtggaaccgcgtgtggatcgaggagaacccctggatggaggacaagacccacatcagctcctggggcgacgtcccgtacctgggcaagcgggaggaccagtggtgcggcagcctcatcgggctgaccgcgcgcgccacgtgggccaccaacatccaggtggccatcaaccaggtgcggcgcctgatcggcaacgagaactacctcgactacatgacctccatgaagcggttcaagaacgagagcgaccccgagggggccctgtggtga

SEQ ID NO: 7989 - RNA, 9879 nt, synthetic construct
  misc_feature 1..9879: note = derived and/or modified CDS sequence (opt1) from DENV-1__GU131888__SS-prME
  source 1..9879: mol_type = other RNA
agcgtgaccatgctgctcatgctgatgcccaccgccctggccttccacctcaccacccggggcggggagccgcacatgatcgtgagcaagcaggagcggggcaagagcctgctgttcaagaccagcgccggggtgaacatgtgcaccctcatcgccatggacctgggcgagctgtgcgaggacaccatgacctacaagtgcccccgcatcaccgaggccgagcccgacgacgtggactgctggtgcaacgccaccgacacctgggtgacctacgggacctgcagccagaccggcgagcaccggcgcgacaagcggtccgtggccctcgcgccccacgtgggcctggggctggagacgcgcaccgagacctggatgagctccgagagcgcctggaagcagatccagcgggtcgagacctgggccctccgccaccccggcttcacggtgatcgccctgttcctggcgcacgccatcgggacctccatcacccagaagggcatcatcttcatcctcctgatgctggtgacccccagcatggccatgcggtgcgtcgggatcggctcccgcgacttcgtggagggcctcagcggggccacgtgggtggacgtcgtgctggagcacggctcctgcgtgaccaccatggccaaggacaagcccaccctggacatcgagctcctgaagacggaggtcaccaaccccgcgatcctgcggaagctctgcatcgaggccaagatcagcaacaccaccacggactcccgctgccccacccagggggaggccaccctggtggaggagcaggacgccaacttcgtgtgccggcgcaccttcgtcgaccggggctggggcaacgggtgcggcctgttcgggaagggcagcctcatcacgtgcgccaagttcaagtgcgtgaccaagctggaggggaagatcgtgcagtacgagaacctgaagtactccgtcatcgtgaccgtgcacaccggcgaccagcaccaggtcggcaacgagagcacggagcacgggaccaccgcgaccatcacgccccaggcccccacgaccgagatccagctcaccgactacggcgccctgaccctggactgcagcccccggacggggctcgacttcaacgagatggtgctgctgaccatgaaggagaagtcctggctcgtccacaagcagtggttcctggacctgccgctcccctggaccagcggcgcctccaccagccaggagacgtggaaccggcaggacctgctggtgaccttcaagaccgcccacgcgaagaagcaggaggtggtcgtgctcgggtcccaggagggcgccatgcacaccgccctgacgggcgccaccgagatccagaccagcgggaccacgaccatcttcgccggccacctgaagtgccgcctcaagatggacaagctgaccctgaaggggatgtcctacgtgatgtgcaccggcagcttcaagctcgagaaggaggtcgcggagacgcagcacgggaccgtgctggtgcagatcaagtacgagggcaccgacgccccctgcaagatccccttcctgacccaggacgagaagggcgtcacgcagaacgggcggctgatcaccgccaacccgatcgtgaccgacaaggagaagcccgtgaacatcgaggccgagccgcccttcggcgagtcctacatcgtcatcggggcgggcgagaaggccctcaagctgagctggttcaagaagggctccagcatcgggaagatgttcgaggccaccgcccgcggcgcccggcgcatggcgatcctgggggacacgggctgggacttcgggtccatcggcggcgtgttcaccagcgtggggaagctcgtccaccagatcttcggcaccgcctacggggtgctgttctccggcgtgagctggaccatgaagatcgggatcggcgtcctgctcacgtggctgggcctgaactcccgcagcacctccctcagcatgacctgcatcgccgtggggctggtgaccctgtacctcggcgtcatggtgcaggccgactccgggtgcgtgatcaactggaagggccgggagctgaagtgcgggagcggcatcttcgtcacgaacgaggtgcacacctggaccgagcagtacaagttccaggccgacagcccgaagcgcctgtccgcggccatcggcaaggcctgggaggagggggtgtgcggcatccggagcgccacccgcctcgagaacatcatgtggaagcagatctccaacgagctgaaccacatcctgctcgagaacgacatgaagttcaccgtcgtggtgggggacgtcgccggcatcctggcgcaggggaagaagatgatccggccccagcccatggagtacaagtacagctggaagtcctggggcaaggccaagatcatcggcgccgacgtgcagaacacgaccttcatcatcgacgggcccaacaccccggagtgccccgacgaccagcgcgcctggaacatctgggaggtggaggactacggcttcgggatcttcaccacgaacatctggctgaagctccgggacagctacacccaggtctgcgaccaccgcctgatgtccgcggccatcaaggacagcaaggccgtgcacgccgacatgggctactggatcgagtccgagaagaacgagacctggaagctggcccgggcgagcttcatcgaggtgaagacctgcatctggcccaagtcccacacgctctggagcaacggcgtcctggagtccgagatgatcatccccaagatctacgggggcccgatcagccagcacaactaccgccccgggtacttcacccagaccgccggcccctggcacctggggaagctcgagctggacttcgacctgtgcgagggcaccacggtggtggtcgacgagcactgcggcaaccgggggccgtccctccgcaccaccaccgtgacgggcaagatcatccacgagtggtgctgccggagctgcaccctgccgcccctgcgcttccgcggggaggacggctgctggtacgggatggagatccgccccgtgaaggagaaggaggagaacctcgtcaagtccatggtgagcgccggcagcggcgaggtggactccttcagcctggggctgctctgcatctccatcatgatcgaggaggtcatgcggagccgctggtcccggaagatgctgatgaccggcaccctggccgtgttcctcctgctgatcatggggcagctcacgtggaacgacctgatccgcctgtgcatcatggtgggcgccaacgcgagcgaccgcatggggatgggcaccacctacctcgccctgatggccaccttcaagatgcggccgatgttcgccgtcgggctcctgttccgccggctgacgtcccgcgaggtgctgctcctgaccatcgggctgagcctcgtggcctccgtcgagctgcccaacagcctggaggagctcggcgacgggctggcgatgggcatcatgatcctgaagctcctgaccgacttccagtcccaccagctgtgggccaccctcctgagcctgacgttcatcaagaccaccttctccctccactacgcctggaagaccatggccatggtgctgagcatcgtctccctgttccccctctgcctgagcacgacctcccagaagaccacctggctgcccgtgctcctgggcagcctggggtgcaagccgctcacgatgttcctgatcgcggagaacaagatctggggccggcgctcctggcccctgaacgaggggatcatggccgtgggcatcgtcagcatcctcctgagctccctgctcaagaacgacgtgcccctggccgggcccctgatcgccggcggcatgctcatcgcctgctacgtgatcagcgggtccagcgcggacctgtccctggagaaggccgccgaggtcagctgggaggaggaggccgagcactccggcgccagccacaacatcctcgtggaggtgcaggacgacgggccgatgaagatcaaggacgaggagcgggacgacaccctgaccatcctgctcaaggcgaccctgctggccgtctccggcgtgtaccccctcagcatccccgccaccctgttcgtgtggtacttctggcagaagaagaagcagcgctccggggtcctgtgggacacgcccagcccgcccgaggtggagcgggccgtgctggacgacggcatctaccgcatcatgcagcggggcctcctggggcgctcccaggtcggcgtgggggtgttccaggagaacgtcttccacaccatgtggcacgtgacccggggcgccgtgctgatgtaccaggggaagcgcctcgagcccagctgggcgtccgtcaagaaggacctgatcagctacggcggcgggtggcggctgcagggctcctggaacaccggggaggaggtccaggtgatcgccgtcgagcccggcaagaacccgaagaacgtgcagacggcccccgggaccttcaagacccccgagggcgaggtgggcgccatcgccctcgacttcaagcccgggaccagcggctccccgatcgtcaaccgcgaggggaagatcgtgggcctgtacggcaacggggtggtcacgaccagcggcacctacgtgagcgcgatcgcccaggccaaggcctcccaggaggggcccctgcccgagatcgaggacgaggtgttccggaagcgcaacctcaccatcatggacctgcacccgggcagcgggaagacgcggcgctacctgcccgcgatcgtccgggaggccatcaagcgcaagctccgcaccctgatcctggcccccacccgggtggtggcctccgagatggccgaggcgctcaagggcatgcccatccgctaccagaccacggccgtcaagagcgagcacaccggcaaggagatcgtggacctgatgtgccacgccaccttcaccatgcggctgctctccccggtgcgcgtccccaactacaacatgatcatcatggacgaggcccacttcacggaccccagctccatcgccgcgcgggggtacatcagcacccgcgtgggcatgggggaggccgccgccatcttcatgaccgccacgccgcccggctccgtggaggcgttcccccagagcaacgccctgatccaggacgaggagcgggacatccccgagcgctcctggaacagcgggtacgagtggatcacggacttccccggcaagaccgtctggttcgtgccctccatcaagagcggcaacgacatcgccaactgcctgcggaagaacgggaagcgcgtgatccagctctcccggaagaccttcgacaccgagtaccagaagacgaagaacaacgactgggactacgtcgtgaccaccgacatcagcgagatgggcgccaacttccgcgcggaccgggtgatcgacccccgccggtgcctgaagcccgtcatcctgaaggacgggcccgagcgcgtgatcctcgccggcccgatgcccgtgaccgtcgcctccgccgcccagcggcgcgggcggatcggccgcaaccacaacaaggagggcgaccagtacatctacatggggcagcccctgaacaacgacgaggaccacgcgcactggacggaggccaagatgctgctcgacaacatcaacacccccgagggcatcatcccggccctgttcgagcccgagcgcgagaagtccgccgccatcgacggggagtaccggctgcgcggcgaggcgcggaagaccttcgtggagctcatgcgccgcggggacctgcccgtctggctgtcctacaaggtggccagcgagggcttccagtacagcgaccgccggtggtgcttcgacggcgagcgcaacaaccaggtgctcgaggagaacatggacgtcgagatctggaccaaggagggggagcggaagaagctgcgcccccggtggctggacgcccgcacgtactccgacccgctcgccctgcgggagttcaaggagttcgccgcgggccgccggagcgtgtccggggacctgatcctcgagatcggcaagctgccccagcacctgacccagcgcgcccagaacgccctcgacaacctggtgatgctgcacaacagcgagcagggcgggcgggcctaccgccacgcgatggaggagctccccgacaccatcgagaccctgatgctgctcgccctgatcgccgtcctgacgggcggggtgaccctcttcttcctgtccggccgggggctgggcaagaccagcatcggcctcctgtgcgtgatggcctccagcgtcctgctctggatggcctccgtggagccccactggatcgcggccagcatcatcctggagttcttcctgatggtgctcctgatcccggagcccgaccgccagcggacgccccaggacaaccagctggcctacgtcgtgatcgggctcctgttcatgatcctgaccgtggccgccaacgagatgggcctcctggagacgaccaagaaggacctggggatcggccacgtcgcggtggggaaccaccaccacgccgccatgctcgacgtggacctgcacccggcctccgcctggaccctgtacgcggtcgccaccacgatcatcacccccatgatgcgccacaccatcgagaacaccacggccaacatcagcctcaccgccatcgccaaccaggcggccatcctgatgggcctggacaagggctggcccatctccaagatggacatcggggtgcccctcctggccctgggctgctacagccaggtgaacccgctcaccctgaccgccgcggtcctgatgctcgtggcccactacgccatcatcgggcccggcctgcaggccaaggccacgcgcgaggcgcagaagcggaccgccgccgggatcatgaagaaccccaccgtggacggcatcgtcgccatcgacctggaccccgtggtgtacgacgccaagttcgagaagcagctcggccagatcatgctgctgatcctctgcacctcccagatcctgctgatgcgcacgacctgggcgctctgcgagagcatcaccctggccaccgggccgctgacgaccctctgggagggctcccccgggaagttctggaacaccaccatcgccgtcagcatggccaacatcttccggggctcctacctggccggcgcggggctggccttcagcctcatgaagtccctgggcgggggccgccgggggacgggcgcccagggcgagaccctgggggagaagtggaagcgccagctcaaccagctgtccaagagcgagttcaacacctacaagcggtccggcatcatggaggtggaccgcagcgaggccaaggaggggctgaagcggggcgagaccacgaagcacgcggtgtcccgcgggaccgccaagctgcggtggttcgtcgagcgcaacctcgtgaagcccgagggcaaggtgatcgacctgggctgcgggcggggcgggtggagctactactgcgccggcctgaagaaggtcaccgaggtgaaggggtacaccaagggcggccccgggcacgaggagccgatccccatggccacgtacggctggaacctcgtgaagctgcactccgggaaggacgtcttcttcatcccgcccgagaagtgcgacaccctgctctgcgacatcggcgagagctccccgaaccccaccatcgaggaggggcgcaccctgcgggtgctgaagatggtggagccctggctccgcggcaaccagttctgcatcaagatcctgaacccctacatgccgagcgtcgtggagacgctggagcagatgcagcggaagcacggcgggatgctcgtgcgcaaccccctgtcccggaacagcacccacgagatgtactgggtctcctgcggcaccgggaacatcgtgagcgccgtgaacatgacctcccgcatgctgctcaaccgcttcaccatggcgcaccggaagcccacgtacgagcgcgacgtcgacctgggcgccggcacccggcacgtggccgtggagcccgaggtcgccaacctggacatcatcgggcagcgcatcgagaacatcaagcacgagcacaagagcacctggcactacgacgaggacaacccgtacaagacctgggcctaccacggctcctacgaggtgaagcccagcgggtccgcgagcagcatggtgaacggcgtcgtgaagctcctgacgaagccctgggacgtcatccccatggtgacccagatcgccatgaccgacaccacgccgttcgggcagcagcgggtgttcaaggagaaggtcgacacccgcacccccaaggccaagcggggcaccgcccagatcatggaggtgacggccaagtggctgtggggcttcctctcccgcaacaagaagccccggatctgcacccgcgaggagttcacccggaaggtgcgcagcaacgcggccatcggggccgtcttcgtggacgagaaccagtggaactccgccaaggaggcggtggaggacgagcggttctgggacctggtccaccgcgagcgggagctgcacaagcagggcaagtgcgcgacctgcgtgtacaacatgatggggaagcgcgagaagaagctcggcgagttcgggaaggccaagggcagccgggccatctggtacatgtggctgggcgcccgcttcctggagttcgaggcgctcgggttcatgaacgaggaccactggttctcccgggagaacagcctgtccggcgtggagggggagggcctgcacaagctcgggtacatcctgcgcgacatcagcaagatcccgggcggcaacatgtacgccgacgacacggccgggtgggacacccggatcaccgaggacgacctgcagaacgaggcccgcatcaccgacatcatggagcccgagcacgccctcctggcgaagtccatcttcaagctgacgtaccagaacaaggtcgtgcgcgtgcagcggcccgccaagaacggcaccgtcatggacgtgatcagccgccgggaccagcgcgggtccggccaggtgggcacctacgggctcaacaccttcacgaacatggaggcccagctgatccggcagatggagagcgagggcatcttctcccccagcgagctggagaccccgaacctcgccgagcgcgtcctggactggctggagaagtacggggtggagcggctcaagcgcatggccatctccggcgacgactgcgtggtcaagcccatcgacgaccggttcgcgaccgccctgaccgccctgaacgacatggggaaggtgcgcaaggacatcccccagtgggagcccagcaagggctggaacgactggcagcaggtcccgttctgctcccaccacttccaccagctcatcatgaaggacggccgggagatcgtcgtgccctgccgcaaccaggacgagctggtggggcgggcccgcgtcagccagggcgccgggtggagcctgcgggagacggcgtgcctcggcaagtcctacgcccagatgtggcagctgatgtacttccaccgccgggacctgcgcctcgccgccaacgcgatctgcagcgccgtgcccgtggactggatccccacctcccggaccacctggagcatccacgcccaccaccagtggatgacgaccgaggacatgctgtccgtctggaaccgcgtgtggatcgaggagaacccgtggatggaggacaagacccacatcagctcctggggcgacgtgccctacctgggcaagcgcgaggaccagtggtgcggcagcctcatcgggctgaccgcccgggccacgtgggcgaccaacatccaggtcgccatcaaccaggtgcgccggctgatcggcaacgagaactacctcgactacatgacctccatgaagcgcttcaagaacgagagcgaccccgagggggccctgtggtga
